US011149254B2

(12) United States Patent
Szalay et al.

(10) Patent No.: US 11,149,254 B2
(45) Date of Patent: Oct. 19, 2021

(54) CLONAL STRAINS OF ATTENUATED VACCINIA VIRUSES AND METHODS OF USE THEREOF

(75) Inventors: Aladar A. Szalay, Highland, CA (US); Nanhai G. Chen, San Diego, CA (US); Yong A. Yu, San Diego, CA (US); Qian Zhang, San Diego, CA (US)

(73) Assignee: Genelux Corporation, San Diego, CA (US)

( * ) Notice: Subject to any disclaimer, the term of this patent is extended or adjusted under 35 U.S.C. 154(b) by 0 days.

(21) Appl. No.: 13/506,369

(22) Filed: Apr. 13, 2012

(65) Prior Publication Data
US 2012/0308484 A1 Dec. 6, 2012

Related U.S. Application Data

(60) Provisional application No. 61/628,684, filed on Nov. 4, 2011, provisional application No. 61/517,297, filed on Apr. 15, 2011.

(51) Int. Cl.
| C12N 7/00 | (2006.01) |
| A61K 35/768 | (2015.01) |
| C07K 16/22 | (2006.01) |

(52) U.S. Cl.
CPC ............. *C12N 7/00* (2013.01); *A61K 35/768* (2013.01); *C07K 16/22* (2013.01); *C07K 2317/622* (2013.01); *C12N 2710/24121* (2013.01); *C12N 2710/24132* (2013.01); *C12N 2710/24143* (2013.01)

(58) Field of Classification Search
None
See application file for complete search history.

(56) References Cited

U.S. PATENT DOCUMENTS

| | | | |
|---|---|---|---|
| 4,215,051 A | 7/1980 | Schroeder et al. ............ 549/250 |
| 4,216,226 A | 8/1980 | Fukuyasu et al. ......... 514/0.546 |
| 4,315,914 A | 2/1982 | Arakawa et al. .......... 424/281.1 |
| 4,603,112 A | 7/1986 | Paoletti et al. ............ 435/235.1 |
| 4,722,848 A | 2/1988 | Paoletti et al. ............ 424/199.1 |
| 4,769,330 A | 9/1988 | Paoletti et al. .............. 435/436 |
| 4,912,199 A | 3/1990 | Lown et al. .................. 530/331 |
| 5,023,252 A | 6/1991 | Hseih ............................ 514/183 |
| 5,110,587 A | 5/1992 | Paoletti et al. ............ 435/235.1 |
| 5,149,653 A | 9/1992 | Roser ............................ 435/260 |
| 5,155,020 A | 10/1992 | Paoletti .......................... 435/69.1 |
| 5,174,993 A | 12/1992 | Paoletti ...................... 424/199.1 |
| 5,221,623 A | 6/1993 | Legocki et al. ............ 435/252.3 |
| 5,179,078 A | 12/1993 | Rollins et al. .................... 514/2 |
| 5,364,773 A | 11/1994 | Paoletti et al. .............. 435/69.1 |
| 5,368,855 A | 11/1994 | Boyle et al. ................ 435/320.1 |
| 5,494,807 A | 2/1996 | Paoletti ........................ 435/69.3 |
| 5,639,275 A | 6/1997 | Baetge et al. ............. 604/891.1 |
| 5,707,928 A | 1/1998 | Baker ........................... 504/139 |
| 5,718,902 A | 2/1998 | Yilma et al. ................ 424/211.1 |
| 5,719,054 A | 2/1998 | Boursnell et al. ......... 435/320.1 |
| 5,762,938 A | 6/1998 | Paoletti et al. ............ 424/199.1 |
| 5,833,975 A | 11/1998 | Paoletti et al. .............. 424/93.2 |
| 5,861,290 A | 1/1999 | Goldsmith et al. ........... 435/456 |
| 5,866,131 A | 2/1999 | Ramshaw et al. ......... 424/186.1 |
| 5,922,576 A | 7/1999 | Tong-Chuan et al. ..... 435/91.41 |
| 5,976,796 A | 11/1999 | Szalay et al. .................... 435/6 |
| 6,093,700 A | 7/2000 | Mastrangelo et al. .......... 514/44 |
| 6,165,779 A | 12/2000 | Engler et al. ............... 435/320.1 |
| 6,190,657 B1 | 2/2001 | Pawelek et al. .............. 424/93.1 |
| 6,217,847 B1 | 4/2001 | Contag et al. .................. 424/9.1 |
| 6,232,523 B1 | 5/2001 | Tan et al. ........................ 800/10 |
| 6,235,967 B1 | 5/2001 | Tan et al. ........................ 800/10 |
| 6,235,968 B1 | 5/2001 | Tan et al. ........................ 800/10 |
| 6,251,384 B1 | 6/2001 | Tan et al. .................... 424/93.21 |
| 6,255,289 B1 | 7/2001 | German et al. ............. 514/44 R |
| 6,265,183 B1 | 7/2001 | Dorner et al. ............... 435/69.1 |
| 6,265,189 B1 | 7/2001 | Paoletti et al. ............... 435/70.1 |
| 6,319,703 B1 | 11/2001 | Speck ........................ 435/235.1 |
| 6,391,579 B1 | 5/2002 | Carrasco et al. ............. 435/393 |
| 6,416,754 B1 | 7/2002 | Brown et al. .............. 424/93.21 |
| 6,428,968 B1 | 8/2002 | Molnar-Kimber et al. . 435/7.23 |
| 6,429,001 B1 | 8/2002 | Hardy ........................ 435/235.1 |
| 6,455,673 B1 | 9/2002 | Collier ........................... 530/350 |
| 6,491,905 B1 | 12/2002 | Sorscher et al. ............. 435/325 |
| 6,503,703 B1 | 1/2003 | Palese et al. ..................... 435/5 |
| 6,537,594 B1 | 3/2003 | Paoletti et al. .............. 424/93.2 |
| 6,548,068 B1 | 4/2003 | Schlom et al. ............. 424/199.1 |
| 6,573,090 B1 | 6/2003 | Breakefield et al. ....... 435/320.1 |
| 6,589,531 B1 | 7/2003 | Andino-Pavlovsky et al. ............ 424/199.1 |
| 6,649,143 B1 | 11/2003 | Contag et al. ................. 424/9.1 |
| 6,664,099 B1 | 12/2003 | Worrall ........................ 435/260 |
| 6,759,038 B2 | 6/2004 | Tan et al. ................... 424/93.21 |
| 6,800,288 B2 | 10/2004 | Ferko et al. ............... 424/199.1 |
| 6,803,199 B2 | 10/2004 | Carrasco et al. ................ 435/6 |
| 6,872,357 B1 | 3/2005 | Bronshtein et al. ............ 422/41 |
| 6,916,462 B2 | 7/2005 | Contag et al. ................. 424/9.6 |

(Continued)

FOREIGN PATENT DOCUMENTS

| CA | 2105277 | 12/2006 |
| CN | 1839201 | 9/2006 |
| EP | 0 037 441 | 10/1981 |
| EP | 0 861 093 | 9/1998 |
| EP | 1 146 125 | 10/2001 |

(Continued)

OTHER PUBLICATIONS

U.S. Appl. No. 13/507,572, filed Jul. 10, 2012, 2012/0276010, Nov. 1, 2012.

(Continued)

*Primary Examiner* — Nicole Kinsey White
(74) *Attorney, Agent, or Firm* — Dentons US LLP; Stephanie Seidman

(57) ABSTRACT

Clonal strains of vaccinia viruses are provided. Also provided are methods of identifying and isolating attenuated and oncolytic clonal strains from virus preparations. Modified recombinant forms of the clonal strains also are provided. The clonal strains and virus preparations can be used for diagnostic and therapeutic methods, in particular for therapy and diagnosis or monitoring treatment of proliferative disorders, including neoplastic diseases, such as, but are not limited to, solid tumors and blood cancers.

65 Claims, No Drawings

Specification includes a Sequence Listing.

(56) References Cited

U.S. PATENT DOCUMENTS

| | | | |
|---|---|---|---|
| 7,045,313 B1 | 5/2006 | Moss et al. ............... 435/69.1 |
| 7,091,030 B2 | 8/2006 | Setiawan et al. .......... 435/235.1 |
| 7,115,270 B2 | 10/2006 | Weltzin et al. ............ 424/232.1 |
| 7,118,740 B1 | 10/2006 | Russell et al. .............. 424/93.6 |
| 7,550,147 B2 | 6/2009 | Howley et al. ............. 424/199.1 |
| 7,588,767 B2 | 9/2009 | Szalay et al. .............. 424/199.1 |
| 7,588,771 B2 | 9/2009 | Szalay et al. .............. 424/232.1 |
| 7,645,456 B2 | 1/2010 | Weltzin et al. ............. 424/232.1 |
| 7,662,398 B2 | 2/2010 | Szalay et al. .............. 424/232.1 |
| 7,754,221 B2 | 7/2010 | Szalay et al. .............. 424/199.1 |
| 7,763,420 B2 | 7/2010 | Stritzker et al. .................. 435/4 |
| 7,820,184 B2 | 10/2010 | Stritzker et al. .......... 424/241.1 |
| 8,021,662 B2 | 9/2011 | Szalay et al. .............. 424/138.1 |
| 8,052,968 B2 | 11/2011 | Szalay et al. .............. 424/199.1 |
| 8,066,984 B2 | 11/2011 | Szalay et al. .............. 424/93.21 |
| 8,137,904 B2 | 3/2012 | Szalay et al. ..................... 435/4 |
| 8,221,769 B2 | 7/2012 | Szalay et al. .............. 424/232.1 |
| 8,323,959 B2 | 12/2012 | Szalay et al. .............. 435/320.1 |
| 8,357,486 B2 | 1/2013 | Stritzker et al. .................. 435/4 |
| 8,586,022 B2 | 11/2013 | Szalay et al. ................ 424/93.2 |
| 8,568,707 B2 | 12/2013 | Szalay et al. .................. 424/9.3 |
| 8,642,257 B2 | 2/2014 | Szalay et al. ..................... 435/5 |
| 8,784,836 B2 | 7/2014 | Szalay et al. .............. 424/199.1 |
| 8,852,927 B2 | 10/2014 | Szalay et al. .............. 435/320.1 |
| 8,859,256 B2 | 10/2014 | Szalay et al. .................. 435/210 |
| 8,865,153 B2 | 10/2014 | Szalay et al. ................ 424/93.2 |
| 9,005,602 B2 | 4/2015 | Szalay et al. .................. 424/93.3 |
| 9,492,534 B2 | 11/2016 | Szalay et al. .............. 424/199.1 |
| 9,944,903 B2 | 4/2018 | Szalay et al. ................ 424/93.3 |
| 2003/0009015 A1 | 1/2003 | Ulrich et al. ................ 536/23.1 |
| 2003/0021768 A1 | 1/2003 | Shen et al. ................... 424/93.2 |
| 2003/0031628 A1 | 2/2003 | Zhao et al. .................... 424/9.6 |
| 2003/0031681 A1 | 2/2003 | McCart et al. ............ 424/186.1 |
| 2003/0044384 A1 | 3/2003 | Roberts et al. .............. 424/93.2 |
| 2003/0059400 A1 | 3/2003 | Szalay ......................... 424/93.2 |
| 2003/0086906 A1 | 5/2003 | Mastrangelo et al. ....... 424/93.2 |
| 2003/0153065 A1 | 8/2003 | Kovesdi et al. ............ 435/235.1 |
| 2003/0198627 A1 | 10/2003 | Arts et al. ................... 424/93.21 |
| 2003/0228261 A1 | 12/2003 | Szalay et al. ................ 424/9.34 |
| 2003/0228330 A1 | 12/2003 | Falkner et al. ............. 424/232.1 |
| 2004/0038410 A1 | 2/2004 | Setiawan et al. ................. 436/8 |
| 2004/0091995 A1 | 5/2004 | Schlom et al. ............. 435/235.1 |
| 2004/0213741 A1 | 10/2004 | Szalay et al. .................. 424/9.6 |
| 2004/0234455 A1 | 11/2004 | Szalay et al. .................. 424/9.6 |
| 2005/0025747 A1 | 2/2005 | Laidlaw et al. .............. 424/93.2 |
| 2005/0031643 A1 | 2/2005 | Szalay et al. .............. 424/199.1 |
| 2005/0032044 A1 | 2/2005 | Setiwan ........................... 435/5 |
| 2005/0063993 A1 | 3/2005 | Schlom et al. ............. 424/199.1 |
| 2005/0069491 A1 | 3/2005 | Yu et al. ....................... 424/1.11 |
| 2005/0214266 A1 | 9/2005 | Morris et al. ................ 424/93.2 |
| 2005/0249670 A1 | 11/2005 | Szalay et al. ................ 424/9.32 |
| 2006/0035857 A1 | 2/2006 | Clayman ......................... 514/44 |
| 2006/0051370 A1 | 3/2006 | Szalay et al. .............. 424/199.1 |
| 2006/0099224 A1 | 5/2006 | Kirn ............................ 424/199.1 |
| 2006/0147420 A1 | 7/2006 | Fueyo et al. ................. 424/93.2 |
| 2006/0193832 A1 | 8/2006 | Domann et al. ............. 424/93.2 |
| 2007/0025981 A1 | 2/2007 | Szalay et al. .............. 424/130.1 |
| 2007/0044164 A1 | 2/2007 | Dickins et al. .................. 800/14 |
| 2007/0086984 A1 | 4/2007 | Coffey et al. ................ 424/93.2 |
| 2007/0202572 A1 | 8/2007 | Szalay et al. ................ 435/69.1 |
| 2007/0212727 A1 | 9/2007 | Szalay et al. ..................... 435/6 |
| 2008/0193373 A1 | 8/2008 | Stritzker et al. ............. 424/1.17 |
| 2009/0053244 A1 | 2/2009 | Chen et al. .................. 424/174.1 |
| 2009/0081639 A1 | 3/2009 | Hill et al. .......................... 435/5 |
| 2009/0098529 A1 | 4/2009 | Chen et al. ....................... 435/5 |
| 2009/0117034 A1 | 5/2009 | Chen et al. .................. 424/1.17 |
| 2009/0117047 A1 | 5/2009 | Szalay et al. .................. 424/9.3 |
| 2009/0117048 A1 | 5/2009 | Szalay et al. .................. 424/9.3 |
| 2009/0117049 A1 | 5/2009 | Szalay et al. .................. 424/9.3 |
| 2009/0117082 A1 | 5/2009 | Lee et al. ...................... 424/93.6 |
| 2009/0123382 A1 | 5/2009 | Szalay et al. .................. 424/9.6 |
| 2009/0136917 A1 | 5/2009 | Szalay et al. ..................... 435/5 |
| 2009/0155287 A1 | 6/2009 | Chen et al. .................. 424/158.1 |
| 2009/0162288 A1 | 6/2009 | Chen et al. .................... 424/9.3 |
| 2009/0175830 A1 | 7/2009 | Fueyo et al. ................. 424/93.2 |
| 2009/0180955 A1 | 7/2009 | Stritzker et al. ............. 424/1.73 |
| 2009/0180987 A1 | 7/2009 | Stritzker et al. ............. 424/93.2 |
| 2009/0311664 A1 | 12/2009 | Fong et al. ......................... 435/5 |
| 2009/0324548 A1 | 12/2009 | Weltzin et al. ............... 424/93.2 |
| 2010/0008946 A1 | 1/2010 | Szalay et al. .............. 424/199.1 |
| 2010/0062016 A1 | 3/2010 | Szalay et al. .............. 424/199.1 |
| 2010/0080775 A1 | 4/2010 | Perricaudet et al. ............. 435/6 |
| 2010/0136658 A1 | 6/2010 | Hermiston et al. ........ 435/235.1 |
| 2010/0196325 A1 | 8/2010 | Szalay et al. ................. 424/93.6 |
| 2010/0233078 A1 | 9/2010 | Szalay et al. ................. 424/1.17 |
| 2011/0293527 A1 | 12/2011 | Chen et al. ..................... 424/9.3 |
| 2011/0300176 A1 | 12/2011 | Szalay ........................ 424/199.1 |
| 2012/0020883 A1 | 1/2012 | Stritzker et al. |
| 2012/0052003 A9 | 3/2012 | Szalay .......................... 424/1.11 |
| 2012/0244068 A1 | 9/2012 | Chen et al. ................... 424/1.11 |
| 2012/0276010 A1 | 11/2012 | Szalay et al. .................. 424/9.1 |
| 2013/0129614 A9 | 5/2013 | Szalay et al. ................. 424/1.11 |
| 2013/0130292 A1 | 5/2013 | Szalay et al. ..................... 435/18 |
| 2013/0273007 A1 | 10/2013 | Szalay et al. ................. 424/93.2 |
| 2013/0280170 A1 | 10/2013 | Szalay ........................... 424/9.2 |
| 2014/0086976 A1 | 3/2014 | Szalay et al. ................... 424/445 |
| 2014/0087362 A1 | 3/2014 | Szalay et al. ..................... 435/5 |
| 2014/0140959 A1 | 5/2014 | Szalay et al. ................. 424/93.2 |
| 2014/0271549 A1 | 9/2014 | Szalay .......................... 424/93.2 |
| 2014/0294891 A1 | 10/2014 | Szalay et al. .............. 424/199.1 |
| 2015/0024403 A1 | 1/2015 | Szalay et al. ..................... 435/7.4 |
| 2015/0175976 A1 | 6/2015 | Szalay et al. ............. C12N 7/00 |
| 2016/0339066 A1 | 11/2016 | Szalay et al. ............... 424/133.1 |
| 2017/0095552 A1 | 4/2017 | Szalay et al. ............... 424/186.1 |
| 2018/0195050 A1 | 7/2018 | Szalay et al. ............... 424/186.1 |
| 2019/0038727 A1 | 2/2019 | Wood et al. ................. 424/204.1 |

FOREIGN PATENT DOCUMENTS

| | | |
|---|---|---|
| EP | 1 281 767 | 2/2003 |
| EP | 1 281 772 | 2/2003 |
| EP | 1 489 164 | 12/2004 |
| EP | 1 512 746 | 3/2005 |
| EP | 1 526 185 | 4/2005 |
| JP | 2010-533718 A | 10/2010 |
| WO | WO 1992/22327 | 12/1992 |
| WO | WO 1993/01296 | 1/1993 |
| WO | WO 1995/31105 | 11/1995 |
| WO | WO 1999/18799 | 4/1999 |
| WO | WO 2000/73479 | 12/2000 |
| WO | WO 2001/053467 | 7/2001 |
| WO | WO 2003/006069 | 1/2003 |
| WO | WO 2003/014380 | 2/2003 |
| WO | WO 2003/049117 | 6/2003 |
| WO | WO 2004/000236 | 12/2003 |
| WO | WO 2004/014314 | 2/2004 |
| WO | WO 2004/030631 | 4/2004 |
| WO | WO 2005/047458 | 5/2005 |
| WO | WO 2007/030668 | 3/2007 |
| WO | WO 2007/075879 | 7/2007 |
| WO | WO 2008/100292 | 8/2008 |
| WO | WO 2008/113078 | 9/2008 |
| WO | WO 2008/150496 | 12/2008 |
| WO | WO 2009/011924 | 1/2009 |
| WO | WO 2009/054996 | 4/2009 |
| WO | WO 2008/156655 | 6/2009 |
| WO | WO 2009/139921 | 11/2009 |
| WO | WO 2010/031837 | 3/2010 |
| WO | WO 2017/044780 | 3/2017 |

OTHER PUBLICATIONS

AACR Press Release Sep. 15, 2011, Virus shows promise for imaging and treating pancreatic cancer, Published on Sep. 15, 2011 [online][retrieved on Jan. 28, 2013] Retrieved from:<URL:aacr.org/home/public--media/aacr-press-releases.aspx?d=2438 [2 pages].

Chen et al., "Tropism of oncolytic vaccinia virus constructs for human mononuclear cell subsets," 27th Annual Meeting Final Program, Society for Immunotherapy of Cancer (SITC), Oct. 26-28, 2012, North Bethesda MD. [oral presentation abstract] [1 page].

(56) References Cited

OTHER PUBLICATIONS

Genelux Press Release Nov. 1, 2012, "Genelux corporation announces early results of a phase I/II clinical trial of virotherapeutic GL-ONC1 in advanced peritoneal cavity cancers," [online] Published on Nov. 1, 2012 [online][retrieved on Jan. 28, 2013] retrieved from: <URL:genelux.com/genelux2012/?page_id=4157 [3 pages].
Genelux Press Release Jun. 28, 2012, "Genelux corporation announces ground-breaking study evaluating oncolytic vaccinia virus in canine cancer patients," [online] Published on Jun. 28, 2012 [online][retrieved on Jan. 28, 2013] Retrieved from:<URL:genelux.com/genelux2012/?page_id=3824 [2 pages].
Genelux Press Release Jun. 14, 2012, "Genelux corporation announces first patient in phase I combination clinical trial of GL-ONC1," [online] Published on Jun. 14, 2012 [online][retrieved on Jan. 28, 2013] Retrieved from:<URL:genelux.com/genelux2012/?page_id=2701 [2 pages].
Genelux Press Release May 31, 2012, "Genelux corporation announces treatment of first patient in phase I/II clinical trial of GL-ONC1 in advanced peritoneal cavity cancers," [online] Published on May 31, 2002 [online][retrieved on Jan. 28, 2013] Retrieved from:<URL:genelux.com/genelux2012/?page_id=2691 [2 pages].
Genelux Press Release May 30, 2012, "Genelux corporation announces phase I data presentation at its 2012 ASCO Annual Meeting of GL-ONCI, its oncolytic virus lead product candidate," [online] Published on May 30, 2012 [online][retrieved on Jan. 28, 2013] Retrieved from:<URL:genelux.com/genelux2012/?page_id=2686 &preview=true [2 pages].
Genelux Press Release Jun. 6, 2011, "ASCO poster presentation unveils preliminary results of phase I clinical trial involving intraveneous administration of GL-ONCI to patients with advanced solid tumor cancers," [online] Published on Jun. 6, 2011 [retrieved on Jan. 28, 2013] Retrieved from:<URL: genelux.com/genelux2012/?page_id=1357, 1 page.
Haddad et al., "A vaccinia virus encoding the human sodium iodide symporter facilitates long-term image monitoring of virotherapy and targeted radiotherapy of pancreatic cancer," J. Nucl. Med. epublish Nov. 8, 2012, 10 pages.
Jourdier et al., "Local im munotherapy of spontaneous feline fibrosarcomas using recombinant poxviruses expressing interleukin 2 (IL2)," Gene Therapy 10: 2126-2132 (2003).
Kuhn, I., "Directed evolution generates a novel oncolytic virus for the treatment of colon cancer," PLoS One 3(6):e2409, 11 pages (2008).
Li et al., "Genomic sequence and analysis of a vaccinia virus isolate from a patient with a smallpox vaccine-related complication," Virol J. 25(3):88, 9 pages (2006).
Moss, B. and P. Earl, "Unit 5.11 Overview of the Vaccinia Virus Expression System," Curr Protoc Protein Sci. Chapter 5: Unit 5.11, 5 pages (2001).
Nakano et al., "Molecular genetics of vaccinia virus: demonstration of marker rescue," Proc. Natl. Acad. Sci. U.S.A 79(5):1593-1596 (1982).
Patil et al., "Oncolytic virotherapy in veterinary medicine: current status and future prospects for canine patients," J. Transl. Med. 10(3):1-10 (2012).
Reading et al., "A soluble chemokine-binding protein from vaccinia virus reduces virus virulence and the inflammatory response to infection," J. Immunol. 170(3):1435-1442 (2003).
Reinboth et al., "Correlation between human and oncolytic vaccinia virus transcriptional profile," 27th Annual Meeting Final Program, Society for Immunotherapy of Cancer (SITC), Oct. 26-28, 2012, North Bethesda, MD., Poster 82 abstract, 3 pages.
Weintraub, A., "Pet dogs help biotech startups find new weapons to fight cancer," Published on Jul. 25, 2012 [online][retrieved on Jan. 28, 2013] Retrieved from:<URL:xconomy.com/san-diego/2012/07/25/pet-dogs-help-biotech-startups-find-new-weapons-to-fight-cancer/?single_page=true, 7 pages.
Office Action, dated Oct. 23, 2012, in connection with related U.S. Appl. No. 13/506,738, 11 pages.
U.S. Appl. No. 13/986,866, filed Jun. 12, 2013.
U.S. Appl. No. 13/573,845, filed Oct. 5, 2012, 2013-0130292, May 23, 2013.
U.S. Appl. No. 13/815,727, filed Mar. 13, 2013.
U.S. Appl. No. 13/815,728, filed Mar. 13, 2013.
Buckel et al., "Combination of fractionated irradiation with anti-VEGF expressing vaccinia virus therapy enhances tumor control by simultaneous radiosensitization of tumor associated endothelium," Int. J. Cancer, doi:10.1002/ijc.28296, 30 pages (2013).
Chernichenko et al., "Oncolytic vaccinia therapy of salivary gland carcinoma," JAMA Otolaryngol Head Neck Surg 139(2):173-182 (2013).
Duggal et al., "Vaccinia virus expressing bone morphogenetic protein-4 in novel glioblastoma orthotopic models facilitates enchanced tumor regression and long-term survival," J. of Translational Medicine 11:155 doi:10.1186/1479-5876-11-155, 30 pages (2013).
Ehrig et al, "Growth inhibition of different human colorectal cancer xenografts after a single intravenous injection of oncolytic vaccinia virus GLV-1h68," Journal of Translation Medicine 11:79, 32 pages (2013).
Genelux Press Release, "First patient treated in Genelux Phase I trial with GL-ONC1 at Memorial Sloan Kettering Cancer Center," Published on Feb. 5, 2013 [online][retrieved on Jul. 3, 2013] Retrieved from:<URL:genelux.com/february-05-2013/, 3 pages.
Genelux Press Release, "Virus engineered to express melanin offers new possibilities to diagnose and treat solid tumor cancers," Published on Feb. 11, 2013 [online][retrieved on Jul. 3, 2013] Retrieved from:<URL:genelux.com/february-11-2013/, 2 pages.
Genelux Press Release, "Genelux corporation presents abstracts at 2013 ASCO annual meeting for clinical trials of GL-ONC1, its oncolytic virus lead product candidate," Published on May 30, 2013 [[online]retrieved on Jul. 3, 2013] Retrieved from:<URL:genelux.com/may-30/2013/, 2 pages.
Genelux Press Release, "Genelux presents abstracts at the 7th international meeting on replicating oncolytic virus therapeutics in Quebec," Published on Jun. 15, 2013 [online][retrieved on Jul. 3, 2013] Retrieved from:<URL:genelux.com/june-15-2013/, 2 pages.
Gholami et al., "Vaccinia virus GLV-1h153 is a novel agent for detection and effective local control of positive surgical margins for breast cancer," Breast Cancer Res 15(2):R26, 32 pages. (2013).
Kyula et al., "Synergistic cytotoxicity of radiation and oncolytic Lister strain vaccinia in V600D/EBRAF mutant melanoma depends on JNK and TNF-alpha signaling," Oncogene doi:10.1038/onc.2013.112, 15 pages (2013).
Nguyen et al., "Vaccinia virus-mediated epxression of human erythropoietin in tumors enchances virotherapy and alleviates cancer-related anemia in mice," Mol Ther., accepted article preview online Jun. 14, 2013, doi:10.1038/mt.2013.149, 36 pages (2013).
Stritzker, J. and A. Szalay, "Single-agent combinatorial cancer therapy," Proc. Natl. Acad. Sci. USA 110(21):8325-8326 (2013).
Stritzker et al., "Vaccinia virus-mediated melanin production allows MR and optoacoustic deep tissue imaging and laser-induced thermotherapy of cancer," Proc. Natl. Acad. Sci., [Epub ahead of print Feb. 11, 2013] 110(9):3316-3320 (2013).
Weibel et al., "Imaging of intratumoral inflammation during oncolytic virotherapy of tumors by 19F-Magnetic resonance imaging (MRI)," PLoS One 8(2):e56317, 12 pages (2013).
Weibel et al., "Treatment of malignant effusion by oncolytic virotherapy in an experimental subcutaneous xenograft model of lung cancer," J. Transl. Med. 11:106, 13 pages (2013)[epub ahead of print May 1, 2013].
Response to International Search Report and Written Opinion dated Oct. 22, 2012, in connection with corresponding International Patent Application No. PCT/US2012/033684, mailed Feb. 14, 2013, 32 pages.
Written Opinion, dated May 10, 2013, in connection with International Patent Application No. PCT/US2012/033684, 9 pages.
Response to Written Opinion dated May 10, 2013, in connection with International Patent Application No. PCT/US2012/033684, mailed Jul. 10, 2013, 10 pages.
U.S. Appl. No. 14/301,813, filed Jun. 11, 2014.
U.S. Appl. No. 13/986,866, filed Jun. 12, 2013, 2013/0273007, Oct. 17, 2013.

(56) References Cited

OTHER PUBLICATIONS

U.S. Appl. No. 12/736,826, filed Jan. 10, 2010, 2011/0064650 2012/0052003, Mar. 17, 2011 Mar. 1, 2012.
U.S. Appl. No. 13/999,616, filed Mar. 11, 2014.
U.S. Appl. No. 13/506,369, filed Apr. 13, 2012, 2012/0308484, Dec. 6, 2012.
U.S. Appl. No. 13/815,727, filed Mar. 13, 2013, 2014/0087362, Mar. 27, 2014.
U.S. Appl. No. 13/998,130, filed Oct. 4, 2013, 2014/0140959, May 22, 2014.
U.S. Appl. No. 13/815,728, filed Mar. 13, 2013, 2013/0280170, Oct. 24, 2013.
U.S. Appl. No. 14/205,174, filed Mar. 11, 2014.
U.S. Appl. No. 13/987,688, filed Aug. 20, 2013, 2014/0086976, Mar. 27, 2014.
Advani et al., "Oncolytic vaccinia virus encoding an anti-VEGF antibody improves the therapeutic efficacy of fractionated radiotherapy in lung tumor xenografts," Abstract, ASTRO 53rd Annual Meeting, Miami Beach, FL, Oct. 2-6, 2011 [2 pages].
Advani et al., "Oncolytic vaccinia virus encoding an anti-VEGF antibody improves the efficacy of fractionated radiotherapy in tumor xenografts," Poster, ASTRO 53rd Annual Meeting, Miami Beach, FL, Oct. 2-6, 2011 [1 page].
Advani et al., "Preferential replication of systemically delivered oncolytic vaccinia virus to focally irradiated glioma xenografts," Clin Cancer Res., 18(9):2579-2590 (2012), Published online Feb. 29, 2012.
Advani et al., "Radiotargeting systemically administered oncolytic vaccinia virus to preferentially replicate in radiated gliomas," Abstract, ASTRO 53rd Annual Meeting, Miami Beach, FL, Oct. 2-6, 2011 [1 page].
Advisory Committee on Immunization Practices (ACIP), "Smallpox vaccination and adverse reactions: guidance for clinicians," MMWR 52(RR-4):1-29 (2003).
Advisory Committee on Immunization Practices (ACIP), "Vaccinia (smallpox) vaccine: recommendations of the Advisory Committee on Immunization Practices (ACIP)," MMWR 50(RR-10):1-26 (2001).
Ahn et al., "Polarized expression of GABA transporters in Madin-Darby canine kidney cells and cultured hippocampal neurons," J. Biol. Chem. 271(12):6917-6924 (1996).
Alcamíet al., "Vaccinia virus strains Lister, USSR and Evans express soluble and cell-surface tumour necrosis factor receptors," J. Gen. Virol. 80:949-959 (1999).
Amato, I., "Luminous with promise," Chem. Eng. News. 84(49):69-73 (2006).
Antoine et al., "Characterization of the vaccinia MVA hemagglutinin gene locus and its evaluation as an insertion site for foreign genes," Gene 177:43-46 (1996).
Arakawa et al., "Clinical trial of attenuated vaccinia virus AS strain in the treatment of advanced adenocarcinoma. Report on two cases," J. Cancer Res. Clin. Oncol. 113(1):95-98 (1987).
Ascierto et al., "Permissivity of the NCI-60 cancer cell lines to oncolytic vaccinia virus GLV-1H68," BMC Cancer 11(I):451 (2011), 28 pages.
Ausubel et al., "Generation of recombinant vaccinia viruses," Unit 16.17 in Short Protocols in Molecular Biology 2nd edition: a compendium of Methods from Current Protocols in Molecular Biology, Green Publishing and John Wiley and Sons: New York, 15:16.71-16.82 (1992).
Barton et al., "GENIS: Gene expression of sodium iodide symporter for noninvasive imaging of gene therapy vectors and quantification of gene expression in vivo", Mol. Ther. 8:508-518 (2003).
Bell et al., "Getting oncolytic virus therapies off the ground," Cancer Cell 4:7-11 (2003).
Bennett et al., "Positron emission tomography imaging for herpes virus infection: implications for oncolytic viral treatments of cancer," Nature Med. 7(7):859-863 (2001).
Benning, N. and Hasset, N., "Vaccinia virus infection during murine pregnancy: a new pathogenesis model for vaccinia fetalis," J. Virol. 78(6):3133-3139 (2004).

Bergsland, E. and A. Venook, "Shedding old paradigms: developing viruses to treat cancer," J. Clin. Oncol. 20(9):2220-2222 (2002).
Blasberg, R. and J. Tjuvajev, "Herpes simplex virus thymidine kinase as a marker/reporter gene for PET imaging of gene therapy," J. Nucl. Med. 43(2):163-169 (1999).
Blasco, R. and B. Moss, "Selection of recombinant vaccinia viruses on the basis of plaque formation," Gene 158:157-162 (1995).
Boelaert et al., "Sodium iodide symproter: a novel strategy to target breast, prostate, and other cancers?" Lancet 361:796-797 (2003).
Boland et al., "Adenovirus-mediated transfer of the thyroid sodium/iodide symporter gene into tumors for a targeted radiotherapy," Cancer Res. 60:3484-3492 (2000).
Bönisch, M. and M. Bruss, "The norepinephrine transporter in physiology and disease", Handb. Exp. Pharmacol. 175:485-524 (2006).
Bonnekoh et al., "Adenoviral-mediated herpes simplex virus-thymidine kinase gene transfer in vivo for treatment of experimental human melanoma," J. Invest. Dermatol. 106(6):1163-1168 (1996).
Brader et al., "Imaging genetically engineered oncolytic vaccinia virus (GLV-1h99) using a human norepinephrine transporter reporter gene," Clin. Cancer Res. 15(11):3791-3801 (2009).
Broder et al., "Expression of foreign genes in cultured human primary macrophages using recombinant vaccinia virus vectors," Gene 142:167-174 (1994).
Brown, M., "Killer into cure—oncolytic viruses," Microbiol. Today 56:128-131 (2005).
Browne et al., "Cancer screening by systemic administration of a gene delivery vector encoding tumor-selective secretable biomarker expression," PLoS One 6:(5):e19530 (2011), 9 pages.
Broyles, S. and M. Kremer, "An in vitro transcription system for studying vaccinia virus early genes," Methods Mol Biol. 269:135-142 (2004).
Broyles, S., "Vaccinia virus transcription," J. Gen. Virol. 84:2293-2303 (2003).
Buller et al., "Decreased virulence of recombinant vaccinia virus expression vectors is associated with a thymidine kinase-negative phenotype," Nature 317:813-815 (1985).
Buller et al., "Genetic basis for vaccinia virus virulence," In: *Vaccinia Viruses as Vectors for Vaccine Antigens*, New York: Elsevier, Quinnan, G., ed., pp. 37-46 (1985).
Buursma et al., "$^{18}$F-FEAU as a radiotracer for herpes simplex virus thymidine kinase gene expression: in-vitro comparison with other PET tracers," Nucl. Med. Commun. 27:25-30 (2006).
Carlin et al., "Sodium-iodide symporter (NIS)-mediated accumulation of [($^{211}$)At]astatide in NIS-transfected human cancer cells," Nucl Med Biol 29:729-739 (2002).
Carlin et al., "In Vitro cytotoxicity of [($^{211}$)At]astatide and [$^{131}$I]iodide to glioma tumor cells expressing the sodium iodide symporter," J. Nucl. Med. 44(I1):1827-1838 (2003).
Casado et al, "Strategies to accomplish targeted expression of transgenes in ovarian cancer for molecular therapeutic applications," Clin. Cancer Res. 7(8):2496-2504 (2001).
Certified English Translation of Chernos et al., "Verifying the safety, inoculability, reactogenicity and antigenic properties of a live recombinant smallpox-hepatitis B vaccine in an experiment on volunteers," Vopr. Virusol. (Moscow) 35:132-135 (1990) [Article in Russian].
Certified English translation of Timiryasova et al., "Analysis of reporter gene expression at different segments of the vaccinia virus genome," Mol. Biol. (Mosk.) 27(2):392-40I (1993) [article in Russian].
Chakrabarti et al., "Vaccinia virus expression vector: coexpression of β-galactosidase provides visual screening of recombinant virus plaques," Mol. Cell Biol. 5:3403-3409 (1985).
Chalikonda, S. and D. Bartlett, "Chapter 4: Vaccinia and Pox-Virus," in: *Cancer Drug Discovery and Development: Gene Therapy for Cancer*, edited by Hunt et al., Humana Press Inc., Totowa, NJ, pp. 73-85 (2007).
Cheadle, E. and A. Jackson, "Bugs as drugs for cancer," Immunol. 107:10-19 (2002).
Chen et al., "Cancer gene therapy by direct tumor injections of a nonviral T7 vector encoding a thymidine kinase gene," Hum. Gene Ther. 9(5):729-736 (1998).

(56) References Cited

OTHER PUBLICATIONS

Chen et al., "Evaluation of combined vaccinia virus-mediated antitumor gene therapy with p53, IL-2, and IL-12 in a glioma model," Cancer Gene Ther. 7(11):I437-1447 (2000).
Chen et al., "Evaluation of cytokine toxicity induced by vaccinia virus-mediated IL-2 and IL-2 antitumor immunotherapy," Cytokine 15(61):305-314 (2001).
Chen et al., "Real-time monitoring of vaccinia .virus infection in cultured cells and in living mice using light-emitting proteins," Proceedings of the 14th International Symposium on Bioluminescence & Chemiluminescence: Chemistry, Biology and Applications, World Scientific: Singapore: 181-184 (2007).
Chen et al., "Replication efficiency of oncolytic vaccinia virus in cell cultures prognosticates the virulence and antitumor efficacy in mice," J. Translational Med. 9(1):164 epub date Sep. 27, 2011, 11 pages.
Chen et al., "A novel recombinant vaccinia virus expressing the human norepinephrine transporter retains oncolytic potential and facilitates deep tissue imaging," Mol. Med. 15(5-6):144-151 (2009).
Chernajovsky et al., "Fighting cancer with oncolytic viruses," BMJ 332(7534):170-172 (2006).
Chernos et al., "Verifying the safety, inoculability, reactogenicity and antigenic properties of a live recombinant smallpox-hepatitis B vaccine in an experiment on volunteers," Vopr. Virusol. (Moscow) 35:132-135 (1990) [article in the Russian language].
Chiocca, E., "Oncolytic viruses," Nat. Rev. Cancer 2(12):938-950 (2002).
Cho et al., "Expression and activity of human Na+/I- symporter in human glioma cells by adenovirus-mediated gene delivery," Gene Ther. 7(9):740-749 (2000).
ClinicalTrials.gov, "Safety study of GL-ONC1, an oncolytic virus, in patients with advanced solid tumors," [online][retrieved on Dec. 2, 2008] Retrieved from:<URL:clinicaltrials.gov/ct2/show/NCT00794131?term=genelux&rank=1 [4 pages].
Condeelis, J. and J. Segall, "Intravital imaging of cell movement in tumours," Nat. Rev. Cancer 3:921-930 (2003).
Conry et al., "Human autoantibodies to carcinoembryonic antigen (CEA) induced by a vaccinia-CEA vaccine," Clin. Cancer Res. 6:34-41 (2000).
Conry et al., "Phase I trial of a recombinant vaccinia virus encoding carcinoembryonic antigen in metastatic adenocarcinoma: comparison of intradermal versus subcutaneous administration," Clin. Cancer Res. 5:2330-2337 (1999).
Corral et al., "Phase I clinical trial of genetically modified and oncolytic vaccinia virus GL-ONCI with green fluorescent protein imaging," 7th NCRI Cancer Conference, Liverpool, UK. Nov. 6-9, 2011, poster, 1 page.
Corral et al., "Phase I clinical trial of genetically modified and oncolytic vaccinia virus GL-ONC1 with green fluorescent protein imaging," 7th NCRI Cancer Conference, Liverpool, UK. Nov. 6-9, 2011, abstract, 2 pages.
Coupar et al., "A general method for the construction of recombinant vaccinia viruses expressing multiple foreign genes," Gene 68:1-10 (1988).
Coupar et al., "Insertion sites for recombinant vaccinia virus construction: effects on expression of a foreign protein," J. Gen. Virol. 81:431-439 (2000).
Davis, J. and B. Fang, "Oncolytic virotherapy for cancer treatment: challenges and solutions," J. Gene Med. 7(11):1380-1389 (2005).
Davison, A. and B. Moss, "Structure of vaccinia virus late promoters," J Mol Biol. 210(4):771-784 (1989).
Dellis et al.,"Protein interactions among the vaccinia virus late transcription factors," Virology 329(2):328-336 (2004).
Dingli et al., "Image-guided radiovirotherapy for multiple myeloma using a recombinant measles virus expressing the thyroidal sodium iodide symporter," Blood 103(5): 1641-1646 (2004).
Dunn et al., "Cancer immunoediting: from immunosurveillance to tumor escape," Nat. Immunol. 3(11):991-998 (2002).

Ebert et al., "Syncytia induction enhances the oncolytic potential of vesicular stomatitis virus in virotherapy for cancer," Cancer Res. 64:3265-3270 (2004).
Emens, L., "Cancer vaccines:on the threshold of success," Expert Opin. Emerg. Drugs 13(2):295-308 (2008).
Everts, B. and H. van der Poel, "Replication-selective oncolytic viruses in the treatment of cancer," Cancer Gene Ther. 12:141-161 (2005).
Ferrara et al., "Bevacizumab (Avastin), a humanized anti-VEGF monoclonal antibody for cancer therapy," Biochem. Biophys. Res. Comm. 333:328-335 (2005).
Flexner et al., "Characterization of human immunodeficiency virus gag/pol gene products expressed by recombinant vaccinia viruses," Virol. 166:339-349 (1988).
Fodor et al., "Vaccinia virus mediated p53 gene therapy for bladder cancer in an orthotopic murine model," J. Urol. 173(2):604-609 (2005).
Frentzen et al., "Anti-VEGF single chain antibody GLAF-1 encoded by oncolytic vaccinia virus significantly enhances antitumor therapy," Proc. Natl. Acad. Sci. U.S.A. 106(31):12915-12920 (2009).
Galmiche et al., "Expression of a functional single chain antibody on the surface of extracellular enveloped vaccinia virus as a step towards selective tumour cell targeting," J. Gen. Virol. 78:3019-3027 (1997).
Gentschev et al., "Use of an oncolytic vaccinia virus for treatment of canine breast cancer in nude mice: preclinical development of a therapeutic agent," Cancer Gene Ther. 16(4):320-328 (2009).
Gentschev et al., "Regression of human prostate tumors and metastases in nude mice following treatment with the recombinant oncolytic vaccinia virus GLV-1h68," J. Biomed. Biotechnol. 2010:1-11 (2010).
Gentschev et al., "Significant growth inhibition of canine mammary carcinoma xenografts following treatment with oncolytic vaccinia virus GLV-1h68," J. Oncol. 2010:1-10 (2010).
Gentschev et al., "Efficient colonization and therapy of human hepatocellular carcinoma (HCC) using the oncolytic vaccinia virus strain GLV-1h68," PLoS One. 6(7): 1-9 (2011).
Gholami et al., "Novel therapy for anaplastic thyroid carcinoma cells using an oncolytic vaccinia virus carrying the human sodium iodide symporter," Surgery 150(6):1040-1047 (2011).
Gnant et al., "Regional versus systemic delivery of recombinant vaccinia virus as suicide gene therapy for murine liver metastases," Ann. Surg. 230(3):352-361 (1999).
Gnant et al., "Systemic administration of a recombinant vaccinia virus expressing the cytosine deaminase gene and subsequent treatment with 5-fluorocytosine leads to tumor-specific gene expression and prolongation of survival in mice," Cancer Res. 59(14):3396-3403 (1999).
Gnant et al, "Tumor-specific gene delivery using recombinant vaccinia virus in a rabbit model of liver metastases," J. Natl. Cancer Inst. 91(20):1744-1750 (1999).
Goebel et al., "Appendix to 'The complete DNA sequence of vaccinia virus,'" Virology 179:517-563 (1990).
Goebel et al., "The complete DNA sequence of vaccinia virus," Virology 179:247-266 (1990).
Goel et al., "Radioiodide imaging and radiovirotherapy of multiple myeloma using VSV(Δ51)-NIS, an attenuated vesicular stomatitis virus encoding the sodium iodide symporter gene," Blood 110(7): 2342-2350 (2007).
Gómez, C. and M. Esteban, "Recombinant proteins produced by vaccinia virus vectors can be incorporated within the virion (IMV form) into different compartments," Arch. Virol. 146: 875-892 (2001).
Greer III, L. and A. Szalay, "Imaging of light emission from the expression of luciferases in living cells and organisms: a review," Luminescence 17(1):43-74 (2002).
Groot-Wassink et al., "Adenovirus biodistribution and noninvasive imaging of gene expression in vivo by positron emission tomography using human sodium/iodide symporter as reporter gene", Hum. Gene Ther. 13:1723-1735 (2002).
Guo et al., "The enhanced tumor selectivity of an oncolytic vaccinia lacking the host range and antiapoptosis genes SPI-1 and SPI-2," Cancer Res. 65(21):9991-9998 (2005).

(56) References Cited

OTHER PUBLICATIONS

Guo, Z. and D. Bartlett, "Vaccinia as a vector for gene delivery," Expert Opin. Biol. Ther. 4(6):901-917 (2004).
Haddad et al., "Insertion of the human sodium iodide symporter to facilitate deep tissue imaging does not alter oncolytic or replication capability of novel vaccinia virus," J. Translational Med. 9:36, 13 pages (2011).
Haddad et al., "A novel genetically modified oncolytic vaccinia virus is effective against a wide range of human cancers," Annals of Surgical Oncology, Epub ahead of print Jan. 19, 2012, 10 pages.
Hall et al., "Adenovirus-mediated herpes simplex virus thymidine kinase gene and ganciclovir therapy leads to systemic activity against spontaneous and induced metastasis in an orthotopic mouse model of prostate cancer," Int. J. Cancer 70(2):183-187 (1997).
Hammond et al., "A synthetic vaccinia virus promoter with enhanced early and late activity," J Virol Methods 66(1):135-138 (1997).
Hanahan, D. and R. Weinberg, "The hallmarks of cancer," Cell 100:57-70 (2000).
Harrington, K., "GL-ONC1 phase I trial at royal marsden hospital," Roche-Genelux Meeting, Penzberg, Germany, Sep. 19, 2011, poster, 25 pages.
Hawkins et al., "Oncolytic biotherapy: a novel therapeutic platform," Lancet Oncol. 3:17-26 (2002).
He et al., "Effective oncolytic vaccinia therapy for human sarcomas," J. Surg. Res. 175(2):e53-e60 (2012).
Hermiston, T. and I. Kuhn, "Armed therapeutic viruses: strategies and challenges to arming oncolytic viruses with therapeutic genes," Cancer Gene Ther. 9:1022-1035 (2002).
Hermiston, T. and D. Kirn, "Genetically based therapeutics for cancer: similarities and contrasts with traditional drug discovery and development," Mol. Ther. 11(4):496-507 (2005).
Hodge et al., "Induction of antitumor immunity by recombinant vaccinia viruses expressing B7-1 or B7-2 costimulatory molecules," Cancer Res. 54(21):5552-5555 (1994).
Hofmann et al., "Vaccinia virus GLV-1h237 carrying a Walker A motif mutation of mouse Cdc6 protein enhances human breast tumor therapy in mouse xenografts," Int. J. Oncol. 38(3):871-878 (2011) [Published online Jan. 18, 2011].
Hung et al., "Vaccinia virus preferentially infects and controls human and murine ovarian tumors in mice," Gene Ther. 14:20-29 (2007).
Ikeda et al., "Oncolytic virus therapy of multiple tumors in the brain requires suppression of innate and elicited antiviral responses," Nat. Med. (8):881-887 (1999).
Isaacs et al., "Vaccinia virus complement-control protein prevents antibody-dependent complement-enhanced neutralization of infectivity and contributes to virulence," Proc. Natl. Acad. Sci. U.S.A. 89:628-632 (1992).
Jia, W. and Q. Zhou, "Viral vectors for cancer gene therapy: viral dissemination and tumor targeting," Curr. Gene Ther. 5:133-142 (2005).
Joklik, W., "The purification of four strains of poxviruses," Virology 18:9-18 (1962).
Kan et al., "Direct retroviral delivery of human cytochrome P450 2B6 for gene-directed enzyme prodrug therapy of cancer," Cancer Gene Ther. 8(7):473-482 (2001).
Kang et al., "Establishment of a human hepatocellular carcinoma cell line highly expressing sodium iodide symporter for radionuclide gene therapy," J Nucl Med 45:1571-1576 (2004).
Karupiah et al., "Vaccinia virus-mediated damage of murine ovaries and protection by viruses-expressed interleukin-2," Immunol. Cell Biol. 68: 325-333 (1990).
Kass et al, "Induction of protective host immunity to carcinoembryonic antigen (CEA), a self-antigen in CEA transgenic mice, by immunizing with a recombinant vaccinia-CEA virus," Cancer Res. 59:676-683 (1999).
Kato et al., "An alternative genetic method to test essential vaccinia virus early genes," J Virol Methods. 115(1):31-40 (2004).

Katz et al., "Mutations in the vaccinia virus A33R and B5R envelope proteins that enhance release of extracellular virions and eliminate formation of actin-containing microvilli without preventing tyrosine phosphorylation of the A36R protein," J. Virol. 77:12266-12275 (2003).
Kaufman et al., "A phase I trial of intra lesional RV-B7.1 vaccine in the treatment of malignant melanoma," Hum. Gene Ther. 11(7):1065-1082 (2000).
Kaufman et al., "A recombinant vaccinia virus expressing human carcinoembryonic antigen CEA," Int. J. Cancer 48(6):900-907 (1991).
Kaufman et al., "Insertion of interleukin-2 (IL-2) and interleukin-12 (IL-12) genes into vaccinia virus results in effective anti-tumor responses without toxicity," Vaccine 20:1862-1869 (2002).
Kaufman et al., "Phase 11 randomized study of vaccine treatment of advanced prostate cancer (E7897): a trial of the Eastern Cooperative Oncology Group," J. Clin. Oncol. 22:2122-2132 (2004).
Kaufman et al., "Targeting the local tumor microenvironment with vaccinia virus expressing B7.1 for the treatment of melanoma," J. Clin. Investigation 115(7):1903-1912 (2005).
Kawa, A. and S. Arakawa, "The effect of attenuated vaccinia virus AS strain on multiple myeloma; a case report," Japan. J. Exp. Med. 58(I): 79-81 (1987).
Kelly et al., "Novel oncolytic agent GLV-1h68 is effective against malignant pleural mesothelioma," Hum. Gene Ther. 19(8):774-782 (2008).
Kelly et al., "Real-time intraoperative detection of melanoma lymph node metastases using recombinant vaccinia virus GLV-1h68 in an immunocompetent animal model," Int. J. Cancer. 124(4):911-918 (2009).
Kim et al., "Overview analysis of adjuvant therapies for melanoma—a special reference to results from vaccinia melanoma oncolysate adjuvant therapy trials," Surg. Oncol. 10:53-59 (2001).
Kirn, D. and F. McCormick, "Replicating viruses as selective cancer therapeutics," Mol. Med. Today 2(12):519-527 (1996).
Kirn et al., "Replication-selective virotherapy for cancer: biological principles, risk management and future directions," Nat. Med. 7:781-787 (2001).
Kirn, D., "Oncolytic virotherapy for cancer with the adenovirus dl1520 (Onyx-015): results of phase I and II trials," Expert Opin. Biol. Ther. 1(3):525-538 (2001).
Lee et al., "Molecular attenuation of vaccinia virus: mutant generation and animal characterization," J. Virol. 66:2617-2630 (1992).
Li et al., "Oncolytic virotherapy as personalized cancer vaccine," Int. J. Cancer 123:493-499 (2008).
Lin et al., "Oncolytic vaccinia virotherapy of anaplastic thyroid cancer in vivo," J. Clin. Endocrinol. Metab. 93:4403-4407 (2008).
Lin et al., "Treatment of anaplastic thyroid carcinoma in vitro with a mutant vaccinia virus," Presented at the 28th Annual Meeting of the American Association of Endocrine Surgeons held on Apr. 29 to May 1, 2007,Surgery, Tuscon, AZ, Surgery 142(6):976-983 (2007).
Liu et al., "Expression of human granulocyte-macrophage colony stimulating factor (hGM-CSF) by recombinant vaccinia virus and its effect on immunogenicity," Zhonghua Shi Yan He Lin Chuang Bing Za Zhi 12(1):47-50 (1998). [article in the Chinese language preceeded by an English language].
Liu et al., "Clinical trial results with oncolytic virotherapy: a century of promise, a decade of progress," Nat. Clin. Pract. Oncol. 4:101-117 (2007).
Liu, T. and D. Kirn, "Systemic efficacy with oncolytic virus therapeutics: clinical proof-of-concept and future directions," Cancer Res. 67:429-432 (2007).
Lusso, P., "Chemokines and viruses: the dearest enemies," Virol. 273:228-240 (2000).
Malhotra et al., "Use of an oncolytic virus secreting GM-CSF as combined oncolytic and immunotherapy for treatment of colorectal and hepatic adenocarcinomas," Surgery 141(4):520-529 (2007).
Massoud, T. and S. Gambhir, "Molecular imaging in living subjects: seeing fundamental biological processes in a new light," Genes Dev. 17:545-580 (2003).
Mastrangelo et al., "Intratumoral recombinant GM-CSF-encoding virus as gene therapy in patients with cutaneous melanoma," Cancer Gene Ther. 6(5):409-422 (1998).

(56) References Cited

OTHER PUBLICATIONS

Mastrangelo et al., "Poxvirus vectors: orphaned and underappreciated", J. Clin. Invest., 105(8):1031-1034 (2000).
Mastrangelo, M. and E. Lattime, "Virotherapy clinical trials for regional disease: In situ immune modulation using recombinant poxvirus vectors," Cancer Gene Ther. 9:1013-1021 (2002).
McAllister et al., "Recombinant yellow fever viruses are effective therapeutic vaccines for treatment of murine experimental solid tumors and pulmonary metastases," J. Virol. 74:9197-9205 (2000).
McCart et al., "Oncolytic vaccinia virus expressing the human somatostatin receptor SSTR2: molecular imaging after systemic delivery using 111 In-pentetreotide," Mol. Ther. 10(3):553-561 (2004).
McCart et al., "Complex interaction between the replicating oncolytic effect and the enzyme/prodrug effect of vaccinia-mediated tumor regression," Gene Ther. 7:1217-1223 (2000).
McCart et al., "Systemic cancer therapy with a tumor-selective vaccinia virus mutant lacking thymidine kinase and vaccinia growth factor genes," Cancer Res. 61:8751-8757 (2001).
McFadden, G., "Poxvirus tropism," Nat. Rev. Microbiol. 3(3):201-213 (2005).
Meyer et al., "Mapping of deletions in the genome of the highly attenuated vaccinia virus MVA and their influence on virulence," J. Gen. Virol. 72(Pt 5):1031-1038 (1991).
Moolten, F., "Tumor chemosensitivity conferred by inserted herpes thymidine kinase genes: paradigm for a prospective cancer control strategy," Cancer Res. 46(10):5276-5281 (1986).
Moore, A., "Effects of viruses on tumors," Annu. Rev. Microbiol. 8:393-410 (1954).
Moroz et al., "Imaging hNET reporter gene expression with 124I-MIBG," J. Nucl. Med. 48:827-836 (2007).
Moss et al., "Genetically engineered poxviruses for recombinant gene expression, vaccination, and safety," Proc. Natl. Acad. Sci. U.S.A. 93:11341-11348 (1996).
Mukherjee et al., "Replication-restricted vaccinia as a cytokine gene therapy vector in cancer: persistent transgene expression despite antibody generation," Cancer Gene Ther. 7(5):663-670 (2000).
Mullen, J. and K. Tanabe, "Viral oncolysis," The Oncologist 7:106-119 (2002).
Mutschler et al., "10. Chemotherapy of malignant tumors," in: *Drug Actions: Basic Principles and Therapeutic Aspects* (medpharm (CRC Press), Suttgart, Germany, pp. 595-612 (1995).
Naik et al., "Intravenous and isolated limb perfusion delivery of wild type and a tumor-selective replicating mutant vaccinia virus in nonhuman primates," Hum. Gene Ther. 17:31-45 (2006).
Netesova et al., "Structural and functional studies of the HindIII-I-genome fragment of vaccinia virus strain L-IVP," Mol Biol (Mosk.) 25(6):1526-32 (1991) [article in Russian, English summary on last page of article].
Niu et al., "Multimodality noninvasive imaging of gene transfer using the human sodium iodide symporter," J Nucl Med 45:445-449 (2004).
Ober et al., "Immunogenicity and safety of defective vaccinia virus lister:comparison with modified vaccinia virus Ankara," J. Virol. 76(15):7713-7723 (2002).
Osborn et al., "A picornaviral 2A-like sequence-based tricistronic vector allowing for high-level therapeutic gene expression coupled to a dual-reporter system," Mol. Ther. 12:569-574 (2005).
Panicali et al., "Vaccinia virus vectors utilizing the β-galactosidase assay for rapid selection of recombinant viruses and measurement of gene expression," Gene 47:193-199 (1986).
Paoletti et al., "Applications of pox virus vectors to vaccination: an update," Proc. Natl. Acad. Sci. 93:11349-11353 (1996).
Parato et al., "Recent progress in the battle between oncolytic viruses and tumours," Nature Rev. 5:965-976 (2005).
Parish, C., "Cancer immunotherapy: the past, the present and the future," Immunol. Cell Biol. 81: 106-113 (2003).
Paul et al., "Redirected cellular cytotoxicity by infection of effector cells with a recombinant vaccinia virus encoding a tumor-specific monoclonal antibody," Cancer Gene Ther. 7(4):615-623 (2000).

Pedersen et al., "A phase I clinical trial of genetically modified and imageable oncolytic vaccinia virus GL-ONC1 with clinical green fluorescent protein (GFP) imaging," J. Clin. Oncol 29: 2011 (abstr 2577) abstract, 2 pages. ASCO Annual Meeting, Jun. 3-7, 2011, 2 pages.
Pedersen et al., "A phase I clinical trial of genetically modified and imageable oncolytic vaccinia virus GL-ONC1 with clinical green fluorescent protein (GFP) imaging," J. Clin. Oncol 29: 2011 (abstr 2577) poster, 1 page. ASCO Annual Meeting, Jun. 3-7, 2011, 1 page.
Peplinski et al., "Prevention of murine breast cancer by vaccination with tumor cells modified by cytokine-producing recombinant vaccinia viruses," Annals Surg. Oncol. 3(1):15-23 (1996).
Peplinsky et al., "In vivo murine tumor gene delivery and expression by systemic recombinant vaccinia virus encoding interleukin-1 beta," Cancer J. Sci. Am. 2(1):21-27 (1996) [abstract].
Peplinski et al., "Vaccinia virus for human gene therapy," Surg. Oncol. Clin. N. Am. 7(3):575-588 (1998).
Perkus et al., "Recombinant vaccinia virus: immunization against multiple pathogens," Science 229(4717):981-984 (1985).
Pfleiderer et al., "A novel vaccinia virus expression system allowing construction of recombinants without the need for selection markers, plasmids and bacterial hosts," J. Gen. Virol. 76:2957-2962 (1995).
Pfleiderer et al., "Requirements for optimal expression of secreted and nonsecreted recombinant proteins in vaccinia virus systems," Protein Exp. Purif. 6(5):559-569 (1995).
Presta et al., "Humanization of an anti-vascular endothelial growth factor monoclonal antibody for the therapy of solid tumors and other disorders," Cancer Res. 57:4593-4599 (1997).
Prikhod'ko et al., "Cloning, sequencing and translation analysis of the vaccinia virus LIVP HindIII N fragment," Genetika 27(6):955-963 (1991) [article in Russian, English summary on last page of article].
Puhlmann et al., "Thymidine kinase-deleted vaccinia virus expressing purine nucleoside phosphorylase as a vector for tumor-directed gene therapy," Hum. Gene Ther. 10(4):649-657 (1999).
Puhlmann et al., "Vaccinia as a vector for tumor-directed gene therapy: biodistribution of a thymidine kinase-deleted mutant," Cancer Gene Ther. 7(1):66-73 (2000).
Qin, H. and S. Chatterjee, "Construction of recombinant vaccinia virus expressing GM-CSF and its use as a tumor vaccine," Gene Ther. 3(1):59-66 (1996).
Raab et al., "Four-color labeling of cell culture and tumors of live mice upon infection with: GFP-Ruc and RFP-CBG99 expressing vaccinia virus strains," Proceedings of the 14th International Symposium on Bioluminescence & Chemiluminescence: Chemistry, Biology and Applications, World Scientific: Singapore, pp. 197-200 (2007).
Ramirez et al., "Biology of attenuated modified vaccinia virus Ankara recombinant vector in mice: Virus fate and activation of B- and T-Cell immune responses in comparsion with the Western Reserve Strain and advantages as a vaccine," J. Virol. 74(2):923-933 (2000).
Ribas et al., "Current developments in cancer vaccines and cellular immunotherapy," J. Clin. Oncol. 21(12): 2415-2432 (2003).
Smith et al., "The formation and function of extracellular enveloped vaccinia virus," J. Gen. Virol. 83:2915-2931 (2002).
Spooner et al., "In suicide gene therapy, the site of subcellular localization of the activating enzyme is more important than the rate at which it activates prodrug," Cancer Gene Ther. 7(10):1348-1356 (2000).
Steele, T., "Recent developments in the virus therapy of cancer," P.S.E.B.M. 223:118-127 (2000).
Steffens et al., "Enhanced green fluorescent protein fusion proteins of herpes simplex virus type I thymidine kinase and cytochrome P450 4B1: applications for prodrug-activating gene therapy," Cancer Gene Ther. 7(5):806-812 (2000).
Stienlauf et al., "Kinetics of formation of neutralizing antibodies against vaccinia virus following re-vaccination," Vaccine 17:201-204 (1999).

(56) References Cited

OTHER PUBLICATIONS

St. Louis University, "A new way to kill cancer: SLU research shows viruses can destroy lung, colon tumors," Published on May 17, 2004 [online][retrieved on Jun. 3, 2010] Retrieved from:<sciencedaily.com/releases/2004/05/040517071951.htm [2 pages].
Stockert et al., "A Survey of the humoral immune response of cancer patients to a panel of human tumor antigens," J. Exp. Med. 187(8):1349-1354 (1998).
Stojdl et al., "VSV strains with defects in their ability to shutdown innate immunity are potent systemic anti-cancer agents," Cancer Cell 4:263-275 (2003).
Stritzker et al., "Evaluation of an in vivo gene induction system in infected tumor-bearing mice," In: *Proceedings of the 14th International Symposium on Bioluminescence & Chemiluminescence: Chemistry, Biology and Applications*. World Scientific:Singapore, pp. 205-208 (2007).
Stritzker et al., "Prodrug converting enzyme gene delivery by L. monocytogenes," BMC Cancer. 8:94, 10 pages (2008).
Sturm et al., "Functional hyper-IL-6 from vaccinia virus-colonized tumors triggers platelet formation and helps to alleviate toxicity of mitomycin C enhanced virus therapy," J. Transl. Med. 10(1):9 (2012) [epub ahead of print Jan. 11, 2012], 40 pages.
Sugimoto, M. and K. Yamanouchi, "Characteristics of an attenuated vaccinia virus strain, LC16m0, and its recombinant virus vaccines," Vaccine 12(8):675-681 (1994).
Sutter, G. and C. Staib, "Vaccinia vectors as candidate vaccines: the development of modified vaccinia virus Ankara for antigen delivery," Curr. Drug Targets—Infectious Disorders 3(3):263-271 (2003).
Symons et al., "A study of the vaccinia virus interferon-γ receptor and its contribution to virus virulence," J. Gen. Virol. 83: 1953-1964 (2002).
Takahashi-Nishimaki et al., "Genetic analysis of vaccinia virus Lister strain and its attenuated mutant LC 16m8: production of intermediate variants by homologous recombination," J. Gen. Virol. 68: 2705-2710 (1987).
Tartaglia et al., "NYVAC: a highly attenuated strain of vaccinia virus," Virology 188(1):217-232 (1992).
Taylor et al., "Comparison of the virulence of wild-type thymidine kinase (tk)-deficient and tk+ phenotypes of vaccinia virus recombinants after intranasal inoculation of mice," J. Gen. Virol. 72 (Pt 1):125-130 (1991).
Thorne, S. and D. Kim, "Future directions for the field of oncolytic virotherapy: a perspective on the use of vaccinia virus," Expert Opin. Biol. Ther. 4(8):1307-1321 (2004).
Thorne et al., "Vaccinia virus and oncolytic virotherapy of cancer," Curr. Opin. Mol. Ther. 7(4):359-365 (2005).
Thorne et al., "The use of oncolytic vaccinia viruses in the treatment of cancer: a new role for an old ally?" Curr. Gene Ther. 5:429-443 (2005).
Tietze et al., "Highly selective glycosylated prodrugs of cytostatic CC-1065 analogues for antibody-directed enzyme tumor therapy," Chembiochem. 2(10):758-765 (2001).
Timiryasova et al., "Analysis of reporter gene expression at different segments of the vaccinia virus genome," Mol. Biol. (Mosk.) 27(2):392-401 (1993) [article in Russian, English abstract on last page of article].
Timiryasova et al., "Radiation enhances the anti-tumor effects of vaccinia-p53 gene therapy in glioma," Technol. Cancer Res. Treat. 2(3):223-235 (2003).
Timiryasova et al., "Antitumor effect of vaccinia virus in glioma model," Oncol. Res. 11(3):133-144 (1999).
Timiryasova et al., "Visualization of vaccinia virus infection using the renilla-luciferase-GFP fusion protein," in: *Bioluminescence & Chemiluminescence: Proceedings of the 11th International Symposium on Bioluminescence Chemiluminescence*: Asilomar Conference Grounds, Pacific Grove, Monterey, California: Sep. 6-10, 2000 / (eds.): Case et al., World Scientific Publishing Co., pp. 457-460 (2001).
Timiryasova et al., "Replication-deficient vaccinia virus gene therapy vector: evalution of exogenous gene expression mediated by PUV-inactivated virus in glioma cells," J. Gene Med. 3:468-477 (2001).
Tjuvajev et al., "Imaging adenoviral-mediated herpes virus thymidine kinase gene transfer and expression in vivo," Cancer Res. 59: 5186-5193 (1999).
Tjuvajev et al., "Imaging herpes virus thymidine kinase gene transfer and expression by positron emission tomography,"Cancer Res. 58(19):4333-4341 (1998).
Tjuvajev et al., "Imaging the expression of transfected genes in vivo," Cancer Res. 55(24):6126-6132 (1995).
Tjuvajev et al., "Noninvasive imaging of herpes virus thymidine kinase gene therapy and expression: a potential method for monitoring clinical gene therapy," Cancer Res. 56(18):4087-4095 (1996).
Toguchi et al., "Suicide gene therapy of C6 glioma cells mediated by replication-deficient and replication competent vaccinia viruses,"[abstract] presented at the Eleventh International Conference on Gene Therapy of Cancer, Dec. 12-14, 2002, San Diego California, Cancer Gene Ther. 10:S32 (2003).
Toth et al., "An oncolytic adenovirus vector combining enhanced cell-to-cell spreading, mediated by the ADP cytolytic protein, with selective replication in cancer cells with deregulated Wnt signaling," Cancer Res. 64: 3638-3644 (2004).
Toyoizumi et al., "Combined therapy with chemotherapeutic agents and herpes simplex virus type I ICP34.5 mutant (HSV-1716) in human non-small cell lung cancer," Human Gene Ther. 10:3013-3029 (1990).
Tscharke, D. and G. Smith, "A model for vaccinia virus pathogenesis and immunity based on intradermal injection of mouse ear pinnae," J. Gen. Virol. 80:2751-2755 (1999).
Tscharke et al., "Dermal infection with vaccinia virus reveals roles for virus proteins not seen using other inoculation routes," J. Gen. Virol. 83:1977-1986 (2002).
Tseng et al., "In vivo antitumor activity of Sindbis viral vectors," J. Natl. Cancer Inst. 94(23):1790-1802 (2002).
Tseng et al., "Systemic tumor targeting and killing by Sindbis viral vectors," Nat. Biotechnol. 22(1): 70-77 (2004).
Tsung et al., "Gene expression and cytopathic effect of vaccinia virus inactivated by psoralen and long-wave UV light," J. Virol. 70:165-171 (1996).
Tsung et al., "Immune response against large tumors eradicated by treatment with cyclophosphamide and IL-12," J. Immunol. 160:1369-1377 (1998).
Umphress et al., "Vaccinia virus mediated expression of human APC induces apoptosis in colon cancer cells," Transgenics 4:19-33 (2003).
Vanderplasschen et al., "Antibodies against vaccinia virus do not neutralize extracellular enveloped virus but prevent virus release from infected cells and comet formation," J. Gen. Virol. 78:2041-2048 (1997).
Vanderplasschen et al., "Intracellular and extracellular vaccinia virions enter cells by different mechanisms," J. Gen. Virol. 79:877-887 (1998).
VECTOR: Ministry of Public Health and Social Development of Russian Federation, State Research Center of Virology and Biotechnology, "WHO Collaborating Centre for Orthopoxvirus Diagnosis and Repository for Variola Virus Strains and DNA," [retrieved on Jan. 3, 2008] Retrieved from:<URL:vector.nsc.ru/DesktopDefault.aspx?1cid=9&tabid=294&tabindex=1 [1 page].
Verma, I. and N. Somia, "Gene therapy-promises, problems and prospects," Nature 389:239-242 (1997).
Vile et al., "The oncolytic virotherapy treatment platform for cancer: unique biological and biosafety points to consider," Cancer Gene Ther. 9:1062-1067 (2002).
Wahl et al., "Improved radioimaging and tumor localization with monoclonal F(ab')2," J. Nucl. Med. 24:316-325 (1983).
Wallack et al., "A Phase III randomized, double-blind, multiinstitutional trial of vaccinia melanoma oncolysate-active specific immunotherapy for patients with Stage II melanoma," Cancer 75(1):34-42 (1995).
Wallack et al., "Increased survival of patients treated with a vaccinia melanoma oncolysate vaccine," Ann. Surg. 226(2):198-206 (1997).

(56) References Cited

OTHER PUBLICATIONS

Wallack et al., "Surgical adjuvant active specific immunotherapy for patients with Stage III melanoma: the final analysis of data from a Phase III, randomized, double-blind, multicenter vaccinia melanoma oncolysate trial," J. Am. Coll. Surg. 187(1):69-79 (1998).

Wang et al., "Renilla luciferase-Aequorea GFP (Ruc-GFP) fusion protein, a novel dual reporter for real-time imaging of gene expression in cell cultures and in live animals," Mol. Genet. Genomics. 268(2):160-168 (2002).

Wang et al., "The Renilla luciferase-modified GFP fusion protein is functional in transformed cells," In: *Bioluminescence & chemiluminescence: Proceedings of the 9th International Symposium on Bioluminescence Chemiluminescence*: held at Woods Hole, Massachusetts, Oct. 1996 / (eds.) Hastings et al., John Wiley & Sons Ltd., pp. 419-422 (1997).

Weibel et al., "Viral-mediated oncolysis is the most critical factor in the late-phase of the tumor regression process upon vaccinia virus infection," BMC Cancer 11:68 1-17 (2011).

Weir, J. and B. Moss, "Determination of the transcriptional regulatory region of a vaccinia virus late gene," J. Virol. 61(1):75-80 (1987).

Wisher, M., "Biosafety and product release testing issues relevant to replication-competent oncolytic viruses," Cancer Gene Ther. 9:1056-1061 (2002).

Wolffe et al., "Deletion of the vaccinia virus B5R gene encoding a 42-kilodalton membrane glycoprotein inhibits extracellular virus envelope formation and dissemination," J. Virol. 67(8):4732-4741 (1993) [erratum in J. Virol. 67:5709-5711 (1993)].

Woo et al., "Advances in oncolytic viral therapy," Curr. Opin. Investig. Drugs 7:549-559 (2006).

Worschech et al., "The immunologic aspects of poxvirus oncolytic therapy," Cancer Immunol. Immunother. 58(9):1355-1362 (2009).

Yang et al., "Whole-body optical imaging of green fluorescent protein-expressing tumors and metastases," Proc. Natl. Acad. Sci. U.S.A. 97(3):1206-1211 (2000).

Yang et al., "Visualizing gene expression by whole-body fluorescence imaging," Proc. Natl. Acad. Sci. 97(22):12278-12282 (2000).

Yettra, M., "Remission of chronic lymphocytic leukemia after smallpox vaccination," Arch. Intern. Med. 139(5):603 (1979).

Yu et al., "Regression of human pancreatic tumor xenografts in mice after a single systemic injection of recombinant vaccinia virus GLV-1h68," Mol. Cancer Ther. 8:141-151 (2009).

Yu et al., "Visualization of molecular and cellular events with green fluorescent proteins in developing embryos: a review," Luminescence 18(1):1-18 (2003) [Erratum in: Luminescence 18(4):243 (2003)].

Yu et al., "Oncolytic vaccinia therapy of squamous cell carcinoma," Mol. Cancer 8:45, 9 pages (2009).

Yu et al. "Visualization of tumors and metastases in live animals with bacteria and vaccinia virus encoding light-emitting proteins," Nat. Biotech. 22(3): 313-320 (2004).

Zeh, H. and D. Bartlett, "Development of a replication-selective, oncolytic poxvirus for the treatment of human cancers," Cancer Gene Ther. 9:1001-1012 (2002).

Zhang et al., "Eradication of solid human breast tumors in nude mice with an intravenously injected light emitting oncolytic vaccinia virus," Cancer Res. 67(20):10038-10046 (2007).

Ricci et al., "Non-invasive radioiodine imaging for accurate quantitation of NIS reporter gene expression in transplanted hearts," Eur J Cadiothorac Surg 33(1):32-39 (2008).

Riedel et al., "Post-transcriptional regulation of the sodium/iodide symporter by thyrotropin", J. Biol. Chem. 276:21458-21463 (2001).

Ring, C., "Cytolytic viruses as potential anti-cancer agents," J. Gen. Virol. 83:491-502 (2002).

Rodriguez et al., "Highly attenuated vaccinia virus mutants for the generation of safe recombinant viruses," Proc. Natl. Acad. Sci. U.S.A. 86:1287-1291 (1989).

Rodriguez et al., "Expression of the firefly luciferase gene in vaccinia virus: A highly sensitive gene marker to follow virus dissemination in tissues of infected animals," Proc. Natl. Acad. Sci. U.S.A. 85:1667-1671 (1988).

Roenigk et al., "Immunotherapy of malignant melanoma with vaccinia virus," Arch. Dermatol. 109:668-673 (1977).

Roseman, N. and M. Slabaugh, "The vaccinia virus HindIII fragment: nucleotide sequence of the left 6.2kb," Virology 178:410-418 (1990).

Rothenberg et al., "Improving the evaluation of new cancer treatments: challenges and opportunities," Nat. Rev. Cancer 3:303-309 (2003).

Rubanyi, G., "The future of human gene therapy," Mol. Aspects Med. 22:113-142 (2001).

Ruoho, A., "How the monoamine transporter garden grows," Mol. Pharmacol. 68(2):272-274 (2005).

Sandell et al., "Synthesis, radiolabeling and preliminary biological evaluation of radiolabeled 5-methyl-6-nitroquipazine, a potential radioligand for the serotonin transporter," Bior. Med. Clin. Lett. 12(24):3611-3613 (2002).

Sanderson et al., "Roles of vaccinia virus EEV-specific proteins in intracellular actin tail formation and low pH-induced cell-cell fusion," J Gen Virol. 79( Pt 6):1415-1425 (1998).

Sanz, P. and B. Moss, "Identification of a transcription factor, encoded by two vaccinia virus early genes, that regulates the intermediate stage of viral gene expression," Proc. Natl. Acad. Sci. 96(6):2692-2697 (1999).

Scholl et al., "Recombinant vaccinia virus encoding human MUC1 and IL2 as immunotherapy in patients with breast cancer," J. Immunother. 23(5):570-580 (2000).

Seubert et al., "Enhanced tumor therapy using vaccinia virus strain GLV-1h68 in combination with β-galactosidase-activatable prodrug seco-analog of duocarmycin SA," Cancer Gene Ther. 18:42-52 (2011).

Shida et al., "Effects and virulences of recombinant vaccinia viruses derived from attenuated strains that express the human T-cell leukemia virus type I envelope gene," J. Virol. 62(12):4474-4480 (1988).

Shimizu et al., "Immunotherapy of tumor-bearing mice utilizing virus help," Cancer Immunol. Immunother. 27(3):223-227 (1988).

Shimura et al., "Iodide uptake and experimental 131I therapy in transplanted undifferentiated thyroid cancer cells expressing the Na+/I-symporter gene," Endocrinology 138:4493-4496 (1997).

Sinkovics, J. and J. Horvath, "Virus therapy of human cancers," Melanoma Res. 13:431-432 (2003).

Sivanandham et al., "Therapeutic effect of a vaccinia colon oncolysate prepared with interleukin-2-gene encoded vaccinia virus studied in a syngeneic CC-36 murine colon hepatic metastasis model," Cancer Immunol. Immunother. 38:259-264 (1994).

Sivanandham et al., "Colon cancer cell vaccine prepared with replication-deficient vaccinia viruses encoding B7.1 and interleukin-2 induce antitumor response in syngeneic mice," Cancer Immunol. Immunother. 46(5):261-267 (1998).

Skolnick, J. and J. Fetrow, "From genes to protein structure and function: novel applications of computational approaches in the genomic era," Trends Biotech. 18:34-39 (2000).

Smanik et al., "Cloning of the human sodium iodide symporter," Biochem. Biophys. Res. Commun. 226:339-345 (1996).

Belin et al., "An oncolytic vaccinia virus expressing the human sodium iodine symporter prolongs survival and facilitates SPECT/CT imaging in an orthotopic model of malignant pleural mesothelioma," Surgery [article in press doi:pii: S0039-6060(13)00326-7], 10 pages, (2013).

International Preliminary Report on Patentability, dated Jul. 25, 2013, in connection with International Patent Application No. PCT/US2012/033684, 35 pages.

U.S. Appl. No. 13/507,572, filed Jul. 10, 2012.

U.S. Appl. No. 13/506,738, filed May 10, 2012, 2012-0244068, Sep. 27, 2012.

U.S. Appl. No. 13/573,845, filed Oct. 5, 2012.

Chen et al., "Oncolytic vaccinia virus: a theranostic agent for cancer," Future Virology, 5(6):763-784 (2010).

(56) References Cited

OTHER PUBLICATIONS

Donat et al., "Preferential colonization of metastases by oncolytic vaccinia virus strain GLV-1h68 in a human PC-3 prostate cancer model in nude mice," Plos One 7(9):e45942, (2012).
Garcel et al., "Genomic sequence of a clonal isolate of the vaccinia virus Lister strain employed for smallpox vaccination in France and its comparison to other orthopoxviruses," J. Gen. Virol. 88:1906-1916 (2007).
Gentschev et al., "Preclinical evaluation of oncolytic vaccinia virus for therapy of canine soft tissue sarcoma," PLoS One 7(5):37239, 12 pages (2012).
Gentschev et al., "Characterization and evaluation of a new oncolytic Vaccinia Virus strain LIVP6.1.1 for canine cancer therapy," Bioengineered 4:2 1-6, (2013).
Haddad et al., "Imaging characteristics, tissue distribution, and spread of a novel oncolytic vaccinia virus carrying the human sodium iodide symporter," PLoS One 7(8):e41647, 9 pages (2012).
Jacobs et al., "Vaccinia virus vaccines: past, present, and future," Antiviral Research 84(1):1-13 (2009).
Olson et al., "Smallpox virus plaque phenotypes: genetic, geographical and case fatality relationships," J. Gen. Virol. 90:792-798 (2009).
Patil et al., "Virotherapy of canine tumors with oncolytic vaccinia virus GLV-1h109 expressing an anti-VEGF single-chain antibody," PLoS One 7(10):e47472, 13 pages (2012).
Reinboth et al., "Correlates between host and viral transcriptional program associated with different oncolytic vaccinia virus isolates," Hum Gene Ther Methods, Epub ahead of print Oct. 17, 2012, pp. 1-41.
Schaefer et al., "Vaccinia virus-mediated intra-tumoral expression of matrix metalloproteinase 9 enhances oncolysis of PC-3 xenograft tumors," BMC Cancer 12(1):366, 20 pages (2012).
Smith et al., "Host range selection of vaccinia recombinants containing insertions of foreign genes into non-coding sequences," Vaccine 11(1):43-53 (1993).
Smith et al., "Oncolytic viruses as novel anticancer agents: turning one scourge against another," Exp. Opin. Invest. Drugs 9(2):311-327 (2000).
Toth et al., "Increasing the efficacy of oncolytic adenovirus vectors," Viruses 2:1844-1866 (2010).
Wang et al., "Oncolytic vaccinia virus Glv-1h68 strain shows enhanced replication in human breast cancer stem-like cells in comparison to breast cancer cells," J. Transl. Med. 10(1):167, 28 pages. (2012).
Yu et al., "Real-time imaging of tumors using replication-competent light emitting microorganisms," Methods Mol. Biol. 872:159-175 (2012).
Partial International Search Report, dated Jul. 26, 2012, in connection with corresponding International Patent Application No. PCT/US2012/033684, 10 pages.
International Search Report and Written Opinion, dated Oct. 22, 2012, in connection with corresponding International Patent Application No. PCT/US2012/033684, 30 pages.
Response to Invitation to Pay Additional Fees, mailed Aug. 23, 2012, in connection with corresponding International Patent Application No. PCT/US2012/033684, 7 pages.
Notification of Decision on Protest, mailed Oct. 23, 2012, in connection with corresponding International Patent Application No. PCT/US2012/033684, 4 pages.
U.S. Appl. No. 11/796,028, filed Apr. 25, 2007, 2007-0202572, Aug. 30, 2007.
U.S. Appl. No. 12/148,542, filed Apr. 17, 2008, 2011-0300176, Dec. 8, 2011.
U.S. Appl. No. 12/589,694, filed Oct. 26, 2009, 2010-0062016, Mar. 11, 2010.
U.S. Appl. No. 10/866,606, filed Jun. 10, 2004, 2004-0234455, Nov. 25, 2004.
U.S. Appl. No. 11/981,976, filed Oct. 31, 2007, 2009-0117047, May 7, 2009.
U.S. Appl. No. 10/485,179, filed Nov. 5, 2004, 2005-0069491, Mar. 31, 2005.
U.S. Appl. No. 11/975,088, filed Oct. 16, 2007, 2009-0098529, Apr. 16, 2009.
U.S. Appl. No. 13/136,519, filed Aug. 2, 2011, 2011-0293527, Dec. 1, 2011.
U.S. Appl. No. 12/156,135, filed May 30, 2008, 2009-0081639, Mar. 26, 2009.
U.S. Appl. No. 12/319,640, filed Jan. 9, 2009, 2009-0180955, Jul. 16, 2009.
U.S. Appl. No. 13/199,567, filed Sep. 1, 2011, 2012-0020883, Jan. 26, 2012.
U.S. Appl. No. 12/157,960, filed Jun. 13, 2008, 2009-117034, May 7, 2009.
U.S. Appl. No. 12/660,314, filed Feb. 23, 2010, 2010-0233078, Sep. 16, 2010.
U.S. Appl. No. 13/506,738, filed May 10, 2012.
U.S. Appl. No. 12/218,953, filed Jul. 18, 2008, 2009-0162288, Jun. 25, 2009.
U.S. Appl. No. 12/660,513, filed Feb. 25, 2010, 2010-0196325, Aug. 5, 2010.
U.S. Appl. No. 12/288,887, filed Oct. 27, 2008, 2009-0136917, May 28, 2009.
U.S. Appl. No. 12/736,826, filed Nov. 10, 2010, 2011-0064650, Mar. 17, 2011.
Adonai et al., "Ex vivo cell labeling with 64Cu-pyruvaldehyde-bis(N4-methylthiosemicarbazone) for imaging cell trafficking in mice with positron-emission tomography," Proc. Natl. Acad. Sci. U.S.A. 99: 3030-3035 (2002).
Agranovski et al. "Rapid detection of airborne viruses by personal bioaerosol sampler combined with the PCR device," Atmospheric Environment 40:3924-3929 (2006).
Akita et al., "Identification of oligopeptides binding to peritoneal tumors of gastric cancer," Cancer Sci. 97(10):1075-1081 (2006).
Al'tshtein et al., "Isolation of a recombinant vaccinia virus based on the LIVP strain inducing the surface antigen of the hepatitis B virus," Dokl. Akad. Nauk. SSSR 285(3):696-699 (1985) [Article in Russian].
ATCC Accession No. VR-1549, [online][retrieved on Apr. 28, 2010][Retrieved from:<URL:atcc.org/ATCCAdvancedCatalogSearch/ProductDetails/tabid/452/Default.aspx?ATCCNum=VR-1549&Template=animalVirology [3 pages]
ATCC Accession No. CCL-107, [online][retrieved on Dec. 10, 2004][Retrieved from:<URL: atcc.org/SearchCatalogs/longview.cfm?atccsearch=yes [2 pages]
ATCC Accession No. CCL-121, [online][ retrieved on Dec. 10, 2004][Retrieved from:<URL:atcc.org/ATCCAdvancedCatalogSearch/ProductDetails/tabid/452/Default.aspx?ATCCNum=VR-1549&Template=animalVirology [3 pages].
ATCC Accession No. CCL-183, [online][retrieved on May 7, 2012][Retrieved from:<URL:atcc.org/ATCCAdvancedCatalogSearch/ProductDetails/tabid/452/Default.aspx [3 pages].
ATCC No. CCL-185, [online][retrieved on May 7, 2012][Retrieved from:<URL:atcc.org/ATCCAdvancedCatalogSearch/ProductDetails/tabid/452/Default.aspx [3 pages].
ATCC No. CCL-70, [online][retrieved on May 7, 2012][Retrieved from:<URL:atcc.org/ATCCAdvancedCatalogSearch/ProductDetails/tabid/452/Default.aspx [3 pages].
ATCC No. CRL-1420, [online][retrieved on May 7, 2012][Retrieved from:<URL:atcc.org/ATCCAdvancedCatalogSearch/ProductDetails/tabid/452/Default.aspx [3 pages].
ATCC No. CRL-1435, [online][retrieved on May 7, 2012][Retrieved from:<URL:atcc.org/ATCCAdvancedCatalogSearch/ProductDetails/tabid/452/Default.aspx?ATCCNum=VR-1549&Template=animalVirology [3 pages].
ATCC No. CRL-1469, [online][retrieved on May 7, 2012][Retrieved from<URL:atcc.org/ATCCAdvancedCatalogSearch/ProductDetails/tabid/452/Default.aspx?ATCCNum=VR-1549&Template=animalVirology [3 pages].
ATCC No. CRL-6105, [online][retrieved on May 7, 2012][Retrieved from:<URL:atcc.org/ATCCAdvancedCatalogSearch/ProductDetails/tabid/452/Default.aspx [2 pages].

(56) References Cited

OTHER PUBLICATIONS

ATCC No. CRL-6475, [online][retrieved on Dec. 10, 2004][Retrieved from:<URL:atcc.org/ATCCAdvancedCatalogSearch/ProductDetails/tabid/452/Default.aspx?ATCCNum=VR-1549&Template=animalVirology [3 pages].

ATCC No. HTB-161, [online][retrieved on May 7, 2012][Retrieved from:<URL:atcc.org/ATCCAdvancedCatalogSearch/ProductDetails/tabid/452/Default.aspx?ATCCNum=VR-1549&Template=animalVirology [3 pages].

ATCC No. HTB-81, [online][retrieved on May 7, 2012][Retrieved from:<URL:atcc.org/ATCCAdvancedCatalogSearch/ProductDetails/tabid/452/Default.aspx?ATCCNum=VR-1549&Template=animalVirology [3 pages].

Baroudy et al., "Incompletely base-paired flip-flop terminal loops link the two DNA strands of the vaccinia virus genome into one uninterrupted polynucleotide chain," Cell 28:315-324 (1982).

Belas et al., "Bacterial bioluminescence: isolation and expression of the luciferase genes from Vibrio harveyi," Science 218:791-793 (1982).

Bernards et al., "Effective tumor immunotherapy directed against an oncogene-encoded product using a vaccinia virus vector," Proc. Natl. Acad. Sci. U.S.A. 84:6854-6858 (1987).

Beshara et al., "Kinetic analysis of 52Fe-labelled iron(III) hydroxide-sucrose complex following bolus administration using positron emission tomography," Br. J. Haematol. 104:288-295 (1999).

Bevis, B. and B. Glick, "Rapidly maturing variants of the Discosoma red fluorescent protein (DsRed)," Nat. Biotechnol., 20(1):83-87 (2002).

Blumenreich et al., "High-dose cisplatin in patients with advanced malignancies," Cancer 55(5):1118-1122 (1985).

Bonfield et al. "A new DNA sequence assembly program," Nucleic Acids. Res., 23:4992-4999 (1995).

Brocks et al., "Species-crossreactive scFv against the tumor stroma marker fibroblast activation protein selected by phage display from an immunized FAP -/- knock-out mouse," Mol. Medicine, 7(7):461-469 (2001).

Broder, C. and P. Earl, "Recombinant vaccinia viruses," Mol. Biotechnol. 13:223-245 (1999).

Calonder et al., "Kinetic modeling of 52Fe/52mMn-citrate at the blood-brain barrier by positron emission tomography," J. Neurochem. 73:2047-2055 (1999).

Carrillo et al., "The multiple sequence alignment problem in biology," SIAM J. Applied Math 48:1073-1082 (1988).

Certified English translation of Al'tshtein [Altshteyn] et al., "Isolation of a recombinant vaccinia virus based on the LIVP strain inducing the surface antigen of the hepatitis B virus," Dokl. Akad. Nauk. SSSR. 285(3):696-699 (1985) [Article in Russian].

Chakrabarti et al., "Compact, synthetic, vaccinia virus early/late promoter for protein expression," BioTechniques 23(6):1094-1097 (1997).

Chamberlain et al., "Costimulation enhances the active immunotherapy effect of recombinant anticancer vaccines," Cancer Res. 56:2832-2836 (1996).

Chkheidze et al., "Identification of DNA binding proteins in vaccinia virus by DNA-protein crosslinking," FEBS 336(2):340-342 (1993).

Contag et al., "Photonic detection of bacterial pathogens in living hosts," Mol. Microbiol. 18:593-603 (1995).

Croyle et al., "Factors that influence stability of recombinant adenoviral preparations for human gene therapy," Pharm. Dev. Technol. 3(3):373-383 (1998).

Davison, A. and B. Moss, "New vaccinia virus recombination plasmids incorporating a synthetic late promoter for high level expression of foreign proteins," Nucleic Acids Res. 18:4285-4286 (1990).

Davison, A. and B. Moss., "Structure of vaccinia virus early promoters," J. Mol. Biol. 210:749-769 (1989).

De Wet et al., "Firefly luciferase gene: structure and expression in mammalian cells," Mol. Cell. Biol. 7: 725-737 (1987).

Dear, S. and R. Staden, "A Sequence assembly and editing program for efficient management of large projects," Nucleic Acids Res. 19(14):3907-3911 (1991).

Djikeng et al., "Viral genome sequencing by random priming methods," BMC Genomics 9:5, 9 pages (2008).

Earl et al., "T-lymphocyte priming and protection against friend leukemia by vaccinia-retrovirus env gene recombinant," Science 234:728-731 (1986).

Earl et al., in Ausubel et al., (eds) *Current protocols in molecular biology*, vol. 3, pp. 16.17.1-16.19-7 (1998).

Escher et al., "Bacterial luciferase αβ fusion protein is fully active as a monomer and highly sensitive in vivo to elevated temperature," Proc. Natl. Acad. Sci. U.S.A. 86(17):6528-6532 (1989).

Estin et al, "Recombinant vaccinia virus vaccine against the human melanoma antigen p97 for use in immunotherapy," Proc. Natl. Acad. Sci. U.S.A. 85:1052-1056 (1988).

Falkner, F. and B. Moss, "*Escherichia coli* gpt gene provides dominant selection for vaccinia virus open reading frames expression vectors," J. Virol. 62(6):1849-1854 (1988).

Falkner, F. and B. Moss, "Transient dominant selection of recombinant vaccinia viruses," J. Virol. 64:3108-3111 (1990).

Flint et al. "An oligo-screening strategy to fill gaps found during shotgun sequencing projects," DNA Seq., 8:241-245 (1998).

Foran et al., "Nucleotide sequence of the LuxA and LuxB genes of the bioluminescent marine bacterium Vibrio fischeri," Nucleic Acids Res. 16: 777 (1988).

Forastiere et al., "Phase III comparison of high-dose paclitaxel + cisplatin + granulocyte colony-stimulating factor versus low-dose paclitaxel + cisplatin in advanced head and neck cancer: Eastern Cooperative Oncology Group Study E1393," J. Clin. Oncol. 19(4): 1088-1095 (2001).

Gazdar et al., "Characterization of paired tumor and non-tumor cell lines established from patients with breast cancer," Int. J. Cancer, 78:766-774 (1998).

Gribskov et al., "Sigma factors from *E. coli*, B. subtilis, phage Spoi, and phage T4 are homologous proteins," Nucl. Acids Res. 14:6745-6763 (1986).

Griffin, H. and A. Griffin, (Eds.) "Computer analysis of sequence data, part I." Methods Mol Biol. 24:1-8, Humana Press, Totowa: New Jersey (1994).

Gros et al., "Bioselection of a gain of function mutation that enhances adenovirus 5 release and improves its antitumoral potency," Cancer Res. 68: 8928-8937 (2008).

Gross-Bellard et al., "Isolation of high-molecular weight DNA from mammalian cells," Eur. J. Biochem. 36:32-38 (1973).

He et al., "A simplified system for generating recombinant adenoviruses," Proc. Natl. Acad. Sci. 95(5):2509-2514 (1998).

Henderson, D. and B. Moss, "Smallpox and vaccinia," In: *Vaccines*. Plotkin, S. and W. Orenstein (eds) W.B. Saunders, Philadelphia, pp. 74-97 (1999).

Hruby et al., "Vaccinia virus vectors: new strategies for producing recombinant vaccines," Clin. Micro. Rev. 3(2):153-170 (1990).

Huang, X. and M. Miller, "A time-efficient, linear-space local similarity algorithm," Adv. Appl. Math. 12:337-357 (1997).

Huang et al., "Claudin-3 gene silencing with siRNA suppresses ovarian tumor growth and metastasis," Proc. Natl. Acad. Sci. 106(9):3426-3430 (2009).

Huang, X., "On global sequence alignment," Computer Applications in the Biosciences 10(3):227-235 (1994).

Isaacs, S., Working safely with vaccinia virus: laboratory technique and the role of vaccinia vaccination., Humana Press, Methods Mol Biol. 269:1-14 (2004).

IUPAC-IUB commission on biochemical nomenclature a one-latter notation for amino acid sequences tentative rules, J. Biol. Chem. 243(13):3557-3559 (1968).

IUPAC-IUB commission on bio-chemical nomenclature symbols for amino-acid derivatives and peptides. Recommendations (1971). Biochem. 11(9):1726-1732 (1972).

Jin et al., "Selection and validation of endogenous reference genes using a high throughput approach," BMC Genomics 5(1):55, 17 pages (2004).

(56) References Cited

OTHER PUBLICATIONS

Kantor et al., "Antitumor activity and immune responses induced by a recombinant carcinoembryonic antigen-vaccinia virus vaccine," J. Natl. Cancer Inst. 84:1084-1091 (1992).
Khalil et al., "Mechanism of action of tubulysin, an antimitotic peptide from myxobacteria," Chembiochem. 7(4):678-683 (2006).
Kim et al., "Systemic armed oncolytic and immunologic therapy for cancer with JX-594, a targeted poxvirus expressing GM-CSF," Mol. Ther. 14(3):361-370 (2006).
Kozak, M., "Structural features in eukaryotic mRNAs that modulate the initiation of translation," J. Biol. Chem. 266:19867-19870 (1991).
Kozlova et al., "Inactiviation and mineralization of aerosol deposited model pathogenic microorganisms over $TiO_2$ and $Pt/TiO_2$," Environ. Sci. Technol. 44:5121-5126 (2010).
Kutinova et al., "Hepatitis B virus proteins expressed by recombinant vaccinia viruses: influence of preS2 sequence on expression surface and nucleocapsid proteins in human diploid cells," Arch. Virol. 134:1-15 (1994).
Kutinova et al., "Search for optimal parent for recombinant vaccinia virus vaccines. Study of three vaccinia virus vaccinal strains and several virus lines derived from them," Vaccine 13(5):487-493 (1995).
Lathe et al., "Tumour prevention and rejection with recombinant vaccinia," Nature 326:878-880 (1987).
Leenders et al., "Blood to brain iron uptake in one Rhesus monkey using [Fe—52]-citrate and positron emission tomography (PET): influence of haloperidol," J. Neural.Transm.Suppl. 43: 123-132 (1994).
Lewis et al., "Comparison of four 64Cu-labeled somatostatin analogues in vitro and in a tumor-bearing rat model: evaluation of new derivatives for positron emission tomography imaging and targeted radiotherapy," J. Med. Chem. 42:1341-1347 (1999).
Li et al., "Photoacoustic imaging of lacZ gene expression in vivo," J. Biomed. Optics 12(2):1-3 (2007).
Lorenz et al., "Isolation and expression of a cDNA encoding Renilla reniformis luciferase," Proc. Natl. Acad. Sci. U.S.A. 88:4438-4442 (1991).
Mackett et al., "General method for production and selection of infectious vaccinia virus recombinants expressing foreign genes," J. Virol., 49(3):857-864 (1984).
Matz et al., "Fluorescent proteins from nonbioluminescent Anthozoa species," Nat. Biotech. 17:969-973 (1999).
Mayford et al., "CaMKII regulates the frequency-response function of hippocampal synapses for the production of both LTD and LTP," Cell 81:891-904 (1995).
McAneny et al., "Results of a Phase I trial of a recombinant vaccinia virus that expresses carcinoembryonic antigen in patients with advanced colorectal cancer," Ann. Surg. Oncol. 3(5):495-500 (1996).
Mikryukov et al., "Structural-functional organization of segment of vaccinia virus genome," Soviet Biotechnology (Biotekhnologiya) 4: 19-25 (1988) [corresponds to pp. 442-449 in the Russian language edition].
Mizutani et al., "Rapid genome sequencing of RNA viruses," Emerging Infectious Diseases 13(2):322-324 (2007).
Monsurro et al., "Anti-viral state segregates two molecular phenotypes of pancreatic adenocarcinoma: potential relevance for adenoviral gene therapy," J. Transl. Med. 8:10, 11 pages (2010).
Moss, B., "Poxvirus vectors: cytoplasmic expression of transferred genes," Curr. Opin. Genet. Dev. 3:86-90 (1993).
Nagai et al., "A variant of yellow fluorescent protein with fast and efficient maturation for cell-biological applications," Nat. Biotechnol. 20(1):87-90 (2002).
Nagase et al., "Effects of intralesional versus ip administration of cisplatin on squamous cell carcinoma of mice," Cancer Treat. Rep. 71(9): 825-829 (1987).
Needleman et al., "A general method applicable to the search for similarities in the amino acid sequences of two proteins," J. Mol. Biol. 48:443-453 (1970).

Newman et al., "Stability of undiluted and diluted vaccinia-virus vaccine, dryvax," J. Inf. Dis. 187:1319-1322(2003).
Nguyen, A. and P. Daugherty, "Evolutionary optimization of fluorescent proteins for intracellular FRET," Nat Biotechnol. 23(3):355-360 (2005).
Niedbala et al. "Equivalence of pulsed-dose-rate to low-dose-rate irradiation in tumor and normal cell lines," Radiation Research 155:297-303 (2001).
Ntziachristos, V., "Going deeper than microscopy: the optical imaging frontier in biology," Nature Methods 7:603-614 (2010).
Oertli et al., "Non-replicating recombinant vaccinia virus encoding murine B-7 molecules effective costimulation of naive CD4+ splenocytes in vitro," J. Gen. Virol. 77: 3121-3125 (1996).
Patel et al., "A poxvirus-derived vector that directs high levels of expression of cloned genes in mammalian cells," Proc. Natl. Acad. Sci. U.S.A. 85: 9431-9435 (1988).
Pinkert et al., "An albumin enhancer located 10 kb upstream functions along with its promoter to direct efficient, liver-specific expression in transgenic mice," Genes Dev. 1:268-276 (1987).
Plotkin, S. and W. Orenstein, editors. "Recombinant vaccinia virus vaccines," in *Vaccines*. 3rd edition. Philadelphia: Saunders, 4 pages (1999).
Prasher et al., "Primary structure of the Aequorea victoris green-fluorescent protein," Gene 111: 229-233 (1992).
Prasher et al., "Sequence comparison of complementary DNAs encoding Aequorin isotypes," Biochem. 26:1326-1332 (1987).
Qin, H. and S. Chatterjee, "Cancer gene therapy using tumor cells infected with recombinant vaccinia virus expressing GM-CSF," Hum. Gene Ther. 7:1853-1860 (1996).
Racaniello et al., "Cloned poliovirus complementary DNA is infectious in mammalian cells," Science 214:916-919 (1981).
Rao et al., "Il-12 is an effective adjuvant to recombinant vaccinia virus-based tumor vaccines," J. Immunol. 156: 3357-3365 (1996).
Rathinavelu et al., "Expression of mdm-2 oncoprotein in the primary and metastatic sites of mammary tumor (GI-101) implanted athymic nude mice," Cancer Biochem. Biophys. 17:133-146 (1999).
Rizzo et al., "An improved cyan fluorescent protein variant useful for FRET," Nat Biotechnol. 22(4):445-449 (2004).
Robbins et al., "Multiple HLA Class II-restricted melanocyte differentiation antigens are recognized by tumor-infiltrating lymphocytes from a patient with melanoma," J. Immunol. 169:6036-6047 (2002).
Roth et al., "p53 as a target for cancer vaccines: recombinant canarypox virus vectors expressing p53 protect mice against lethal tumor cell challenge," Proc. Natl. Acad. Sci. U.S.A. 93:4781-4786 (1996).
Sabatino et al., "Conservation of genetic alterations in recurrent melanoma supports the melanoma stem cell hypothesis," Cancer Res 68(1):122-131 (2008).
Sambrook et al., in: *Molecular Cloning, A Laboratory Manual*, Cold Spring Harbor Laboratory Press vol. 3, p. B. 13 (1989).
Scheiflinger et al., "Construction of chimeric vaccinia viruses by molecular cloning and packaging," Proc. Natl. Acad. Sci. 89:9977-9981 (1992).
Schwartz, R. and M. Dayhoff, eds., "Matrices for detecting distant relationships," in *Atlas of protein sequence and structure*, Chapter 23, National Biomedical Research Foundation, pp. 353-358 (1979).
Shaner et al., "A guide to choosing fluorescent proteins," Nat Methods. 2(12):905-909 (2005).
Shchelkunov et al., "The gene encoding the late nonstructural 36K protein of vaccinia virus is essential for virus reproduction," Virus Res. 28: 273-283 (1993).
Shen, Y. and J. Nemunaitis, "Fighting cancer with vaccinia virus: teaching new tricks to an old dog," Mol. Ther. 11(2):180-195 (2005).
Shine, J. and L. Dalgarno, "Determinant of cistron specificity in bacterial ribosomes," Nature 254(5495):34-38 (1975).
Shkrob et al., "Far-red fluorescent proteins evolved from a blue chromoprotein from Actinia equine," Biochem J. 392(Pt 3):649-654 (2005).
Simon et al., "Current challenges in understanding melanogenesis: bridging chemistry, biological control, morphology, and function," Pigment Cell Melanoma Res. 22:563-579 (2009).

(56) References Cited

OTHER PUBLICATIONS

Smith, G. and B. Moss, "Infectious poxvirus vectors have capacity for at least 25000 base pairs of foreign DNA," Gene 25:21-28 (1983).
Smith, T. and M. Waterman, "Comparison of biosequences," Adv. Appl. Math. 2:482-489 (1981).
Sroller et al., "Effect of 3-beta-hydroxysteroid dehydrogenase gene deletion on virulence and immunogenicity of different vaccinia viruses and their recombinants," Arch. Virol. 143:1311-1320 (1998).
Sutton et al., "TIGRassembler: a new tool for assembling large shotgun sequencing projects," Genome Science & Tech. 1:9-19 (1995).
Theodore et al., "Establishment and characterization of a pair of non-malignant and malignant tumor derived cell lines from an African American prostate cancer patient," Int. J. Oncology 37:1477-1482 (2010).
Theon et al., "Intratumoral chemotherapy with cisplatin in oily emulsion in horses," J. Am. Vet. Med. Assoc. 202(2):261-267 (1993).
Thorne et al., "Rational strain selection and engineering creates a broad-spectrum, systemically effective oncolytic poxvirus, JX-963," J. Clin. Invest. 117:3350-3358 (2007).
Timiryasova et al., "Construction of recombinant vaccinia viruses using PUV-inactivated virus as a helper," BioTechniques 31:534-540 (2001).
Timiryasova et al., "Vaccinia virus-mediated expression of wild-type p53 suppresses glioma cell growth and induces apoptosis," Int. J. Oncol. 14(5):845-854 (1999).
Traktman, P., Poxvirus DNA replication, in *DNA Replication in Eukaryotic Cells* (Depamphilis, D., ed.), Cold Spring Harbor Laboratory, Cold Spring, NY, pp. 775-798 (1996).
Tysome et al., "Lister strain of vaccinia virus armed with endostatin-angiostatin fusion gene as a novel therapeutic agent for human pancreatic cancer," Gene Ther. 16(10):1223-1233 (2009).
Vidal et al., "Tissue-specific control elements of the Thy-1 gene," EMBO J. 9(3):833-840 (1990).
Wang et al., "Clonal persistence and evolution during a decade of recurrent melanoma," J. Invest. Dermatol. 126(6):1372-1377 (2006).
Wang et al., "Evolution of new nonantibody proteins via iterative somatic hypermutation," Proc Natl Acad Sci USA. 101(48):16745-16749 (2004).
Wang, E., "RNA amplification for successful gene profiling analysis," J. Transl. Med. 3:28, 11 pages (2005).
Watson et al. (Eds.), "Molecular Biology of the Gene," 4th Edition, The Benjamin/Cummings Pub. Co., p. 224 (1987).
Wiedenmann et al., "A far-red fluorescent protein with fast maturation and reduced oligomerization tendency from Entacmaea quadricolor (Anthozoa, Actinaria)," Proc Natl Acad Sci USA., 99(18):11646-11651 (2002).
Williams et al., "Isolation of temperature-sensitive mutants of adenovirus type 5," J. Gen. Virol. 11:95-101 (1971).
Worschech et al., "Systemic treatment of xenografts with vaccinia virus GLV-1h68 reveals the immunologic facet of oncolytic therapy," BMC Genomics 10:301, 22 pages (2009).
Wu et al., "High resolution microPET imaging of carcino-embryonic antigen-positive xenografts by using a copper-64-labeled engineered antibody fragment," Proc. Natl. Acad. Sci. U.S.A. 97(15):8495-8500 (2000).
Yan et al., "Developing novel oncolytic adenoviruses through bioselection," J. Virol., 77(4):2640-2650 (2003).
Yu et al., "A Renilla luciferase-Aequorea GFP (ruc-gfp) fusion gene construct permits real-time detection of promoter activation by exogenously administered mifepristone in vivo," Mol. Genet. Genomics., 268(2):169-178 (2002).
Zeng et al., "Both natural and designed micro RNAs can inhibit the expression of cognate mRNAs when expressed in human cells," Mol. Cell 9: 1327-1333 (2002).

Zhang et al., "The highly attenuated oncolytic recombinant vaccinia virus GLV-1h68: comparative genomic features and the contribution of F14.5L inactivation," Mol. Genet. Genomics 282(4):417-435 (2009).
Zimmermann et al., "Independent regulatory elements in the nestin gene direct transgene expression to neural stem cells," Neuron 12:11-24 (1994).
Zinoviev et al., "Identification of the gene encoding vaccinia virus immunodominant protein p35," Gene 147: 209-214 (1994).
Chen et al., "Targeting hematologic malignancies with oncolytic vaccinia virus constructs," J Immunother Cancer, 1(Suppl 1): P226 (2013).
Chen et al., "Tropism of oncolytic vaccinia virus constructs for human mononuclear cell subsets," 27th Annual Meeting Final Program, Society for Immunotherapy of Cancer (SITC), Oct. 26-28, 2012, North Bethesda MD. [Presentation slides] [online] Retrieved from:URL:sitcancer.org/meetings/am12/presentations/index.php?filename=AM-FRI-3.15 pm Boris Minev SITC_2012.pdf, 9 pages.
Gentschev et al., "Oncolytic virotherapy of canine and feline cancer," Viruses 6:2122-2137 (2014).
McMillian et al. "An improved resazurin-based cytotoxicity assay for hepatic cells," Cell Biol. Toxicology, 18:157-173 (2002).
O'Donoghue et al., "Polymerase chain reaction-based species verification and microsatellite analysis for canine cell line validation," J. Vet. Diagn. Invest. 23:780-785 (2011).
Response to Rule 161 162 Communication, submitted May 28, 2014, in connection with corresponding European Patent Application No. 12716971.2, 14 pages.
U.S. Appl. No. 14/301,813, filed Jun. 11, 2014, 2014/0294891, Oct. 2, 2014.
U.S. Appl. No. 13/999,616, filed Mar. 11, 2014, 2014/0271549, Sep. 18, 2014.
U.S. Appl. No. 14/501,692, filed Sep. 30, 2014, 2015/0024403, Jan. 22, 2015.
U.S. Appl. No. 14/638,604, filed Mar. 4, 2015.
Letter/Written Disclosure of the Supplemental Information Disclosure Statement for the above-referenced application, dated Apr. 17, 2015, 2 pages.
Hofmann et al., "Combination treatment with oncolytic Vaccinia virus and cyclophosphamide results in synergistic antitumor effects in human lung adenocarcinoma bearing mice," Journal of Translational Medicine 12:197 (2014).
Stritzker et al., "Inducible gene-expression in tumors colonized by modified oncolytic vaccinia virus strains" J Virol. 8(19):11556-11567 (2014).
Letter/Written Disclosure of the Supplemental Information Disclosure Statement for the above-referenced application, dated Aug. 28, 2015, 3 pages.
Official Action, dated Apr. 29, 2015, in connection with corresponding Chinese Patent Application No. 201280029139.8, 13 pages.
Letter/Written Disclosure of the Supplemental Information Disclosure Statement for the above-referenced application, dated Jan. 21, 2016, 2 pages.
Kober et al., "Microglia and astrocytes attenuate the replication of the oncolytic vaccinia virus LIVP 1.1.1 in murine GL261 gliomas by acting as vaccinia virus traps," Journal of Translational Medicine 13:216 (2015).
Mell et al., "Phase I trial of intravenous attenuated vaccinia virus (GL-ONC1) with concurrent chemoradiotherapy (CRT) for locoregionally advanced head and neck carcinoma," J. Clinical Oncology 33(15):6026 (2015).
Response to Official Action, dated Nov. 16, 2015, in connection with corresponding Chinese Patent Application No. 201280029139. 8, 33 pages [original document as filed in Chinese ane instructions in English].
Communication pursuant to Rule 164(2)(a), dated Nov. 6, 2015, in connection with corresponding European Patent Application No. 12 716 971.2, 6 pages.
Letter/Written Disclosure of the Supplemental Information Disclosure Statement for the above-referenced application, filed herewith on Apr. 6, 2016, 3 pages.

(56) References Cited

OTHER PUBLICATIONS

Communication Pursuant to Rule 164(2)(b) and Article 94(3)EPC, dated Mar. 1, 2016, and received Mar. 9, 2016, in connection with corresponding European Patent Application No. 12716971.2, 5 pages.
Letter/Written Disclosure of the Information Disclosure Statement for the above-referenced application, filed herewith on Nov. 9, 2016, 2 pages.
Frentzen et al., "Use of GLV-1h68 for Vaccinia Virotherapy and Monitoring," Gene Therapy of Solid Cancers, Methods in Molecular Biology 1317:225-237 (2015).
Haddad D. et al., "Molecular network, pathway, and functional analysis of time-dependent gene changes associated with pancreatic cancer susceptibility to oncolytic vaccinia virotherapy," Mol Ther Oncolytics 3:16008 (2016).
Pugalenthi et al., "Recombinant vaccinia virus GLV-1h68 is a promising oncolytic vector in the treatment of cholangiocarcinoma," Cancer Gene Therapy 22:591-596 (2015).
Wollmann et al., "Targeting Human Glioblastoma Cells: Comparison of Nine Viruses with Oncolytic Potential," J.Virol, 79(10): 6005-6022 (2005).
Office Action, dated Mar. 17, 2016, in connection with corresponding Chinese Patent Application No. 201280029139.8 [English translation and original document in Chinese], 16 pages.
Office Action, dated Aug. 1, 2016, in connection with Eurasian Patent Application No. 201301173 [English summary of Office Action, claims in English, English letter, and original document in Russian], 9 pages.
Response, filed Sep. 8, 2016, to Examination Report, dated Mar. 1, 2016, in connection with European Patent Application No. 12716971. 2, 12 pages.
Office Action, dated Feb. 23, 2016, in connection with corresponding Japanese Patent Application No. 2014-505384 [English translation and original document in Japanese], 9 pages.
Response, filed Aug. 22, 2016, and substantial argument, filed Sep. 9, 2016, in response to Office Action, dated Feb. 23, 2016, in connection with corresponding Japanese Patent Application No. 2014-505384 [English instructions, document as filed in Japanese, and English claims], 33 pages.
Letter/Written Disclosure of the Supplemental Information Disclosure Statement for the above-referenced application, filed herewith on May 5, 2017, 2 pages.
Official Action, dated Feb. 7, 2017, in connection with corresponding Japanese Patent Application No. 2014-505384 [English summary, original document in Japanese, and English translation], 9 pages.
Letter/Written Disclosure of the Supplemental Information Disclosure Statement for the above-referenced application, filed herewith on Aug. 1, 2017, 2 pages.
Response, filed Dec. 29, 2016, to Office Action issued in connection with corresponding Chinese Patent Application No. 201280029139.8 [English instructions and document as filed in Chinese], 40 pages.
Office Action, dated May 11, 2017, in connection with corresponding Chinese Patent Application No. 201280029139.8 [English translation and original document in Chinese], 13 pages.
Examination Report, dated May 18, 2017, in connection with corresponding European Patent Application No. 12716971.2, 4 pages.
Letter/Written Disclosure of the Supplemental Information Disclosure Statement for the above-referenced application, filed herewith on Mar. 26, 2018, 2 pages.
Genelux Press Release, "Genelux to Present Posters Supporting Lead Oncolytic Virual Therapy GL-ONC1 at ASCO Animal Meeting 2015," Published May 12, 2015 [online]; Retrieved Oct. 18, 2017, from: <URL:genelux.com/wp-content/uploads/2015/05/Genelux-ASCO-2015-Curtain-Raiser-Release-FINAL-5-11-15.pdf, 2 pages.
Genelux Press Release, "Genelux Announces Promising Data from Two Phase I Trials of GL-ONC1 in Head & Neck Cancer and Mesothelioma," Published May 27, 2015 [online]; Retrieved Oct. 18, 2017, from: <URL:genelux.com/wp-content/uploads/2015/05/Genelux-ASCO-2015-Data-Release-5-26-15-FINAL.pdf, 3 pages.
Krug et al., "Phase I study of intra-pleural administration of GL-ONC1, an oncolytic vaccinia virus, in patients with malignant pleural effusion," Abstract 7559, ASCO Annual Meeting, Chicago, IL, May 29-Jun. 2, 2015, 3 pages.
Mell et al., "Phase I trial of intravenous attenuated vaccinia virus (GL-ONC1) with concurrent chemoradiotherapy (CRT) for locoregionally advanced head and neck carcinoma," Abstract 6026, ASCO Annual Meeting, Chicaco, IL, May 29-Jun. 2, 2015, 3 pages.
Response, filed Sep. 26, 2017, to Office Action, dated May 11, 2017, in connection with corresponding Chinese Patent Application No. 201280029139.8 [English instructions and original document as filed in Chinese], 51 pages.
Response, filed Sep. 21, 2017, to Communication pursuant to Article 94(3) EPC (Examination Report), dated May 18, 2017, in connection with corresponding European Patent Application No. 12716971.2, 10 pages.
Response, filed Aug. 7, 2017, and substantial argument, filed Aug. 18, 2017, to Office Action, dated Feb. 7, 2017, in connection with corresponding Japanese Patent Application No. 2014-505384 [English instructions and amended claims, and document as filed in Japanese], 36 pages.
Office Action, dated Jan. 30, 2018, in connection with corresponding Japanese Patent Application No. 2014-505384 [English translation and original document in Japanese], 6 pages.
Summons to Oral Proceedings, dated Mar. 1, 2018, issued in connection with corresponding European Patent Application No. 12716971.2, 5 pages.
Letter/Written Disclosure of the Supplemental Information Disclosure Statement for the above-referenced application, filed herewith on Apr. 26, 2018, 3 pages.
Decision of Rejection, dated Feb. 26, 2018 and received Mar. 27, 2018, in connection with corresponding Chinese Patent Application No. 201280029139.8 [English translation and original document in Chinese], 11 pages.
Letter/Written Disclosure of the Supplemental Information Disclosure Statement for the above-referenced application, filed herewith on Oct. 2, 2018, 3 pages.
Result of Consultation, dated Aug. 24, 2018, in connection with European Patent Application No. 12 716 971.2, 2 pages.
Brief Communication, dated Sep. 11, 2018, confirming cancellation of Oral Proceedings, in connection with corresponding European Patent Application No. 12 716 971.2, 2 pages.
Decision to Grant, dated Sep. 5, 2018, in connection with corresponding Japanese Patent Application No. 2014-505384 [English reporting letter and original document in Japanese], 4 pages.
Letter/Written Disclosure of the Supplemental Information Disclosure Statement for the above-referenced application, filed herewith on Nov. 5, 2018, 2 pages.
Genelux Press Release, "Genelux Initiates Two Clinical Trials of GL-ONC1 in Ovarian Cancer and Solid Organ Cancers with Leading Oncology Institutions," Published Jul. 28, 2016 [online]; Retrieved Jul. 23, 2018, from: <URL:genelux.com/wp-content/uploads/2012/04/2016.07.28-Genelux-Florida-Hospital-UCSD-Phase-1-Trials-Initiation-Release-FINAL.pdf, 3 pages.
Genelux Press Release, "Genelux Initiates Phase 2 Clinical Trial of GL-ONC1 in Recurrent Ovarian Cancer," Published Sep. 27, 2017 [online]; Retrieved Jul. 23, 2018, from: <URL:genelux.com/wp-content/uploads/2012/04/2017.09.27-Genelux-Initiates-Phase-2-Clinical-Trial-of-GL-ONC1-in-Recurrent-Ovarian-Cancer.pdf, 2 pages.
Genelux Press Release, "Genelux Announces Gynecologic Oncology Associates/Women's Cancer Research Foundation as New Site for the Ongoing Phase 2 VIRO-15 Study," Published Jan. 4, 2018 [online]; Retrieved Jul. 23, 2018, from: <URL:genelux.com/wp-content/uploads/2012/04/2018.01.04-Genelux-Announces-GOA-as-New-Site.pdf, 2 pages.
Request for Re-Examination, filed Jun. 13, 2018, to Decision of Rejection, dated Feb. 26, 2018, in connection with corresponding Chinese Patent Application No. 201280029139.8 [English instructions and document as filed in Chinese], 48 pages.
Response, filed Aug. 9, 2018, to Summons to Oral Proceedings, dated Mar. 1, 2018, in connection with corresponding European Patent Application No. 12716971.2, (Part 1 of 2, 298 pages of 521 pages).

(56) References Cited

OTHER PUBLICATIONS

Response, filed Aug. 9, 2018, to Summons to Oral Proceedings, dated Mar. 1, 2018, in connection with corresponding European Patent Application No. 12716971.2, (Part 2 of 2, 223 pages of 521 pages).
Response, filed Sep. 10, 2018, to Result of Consultation, dated Aug. 24, 2018, in connection with corresponding European Patent Application No. 12 716 971.2, 111 pages.
Response, filed May 29, 2018, to Office Action, dated Jan. 30, 2018, in connection with corresponding Japanese Patent Application No. 2014-505384 [English instructions and amended claims, document as filed in Japanese and English translation of claims as-filed], 16 pages.
Request for Accelerated Examination, filed Sep. 7, 2018, in connection with corresponding Japanese Patent Application No. 2018-102428 [English instructions, original document as filed in Japanese and attached references], (Part 1 of 3, 352 pages of 583 pages.).
Request for Accelerated Examination, filed Sep. 7, 2018, in connection with corresponding Japanese Patent Application No. 2018-102428 [English instructions, original document as filed in Japanese and attached references], (Part 2 of 3, 149 pages of 583 pages).
Office Action, dated Oct. 16, 2018, in connection with corresponding Japanese Patent Application No. 2018-102428 [English summary and translation, and original document in Japanese], 8 pages.
Request for Accelerated Examination, filed Sep. 7, 2018, in connection with corresponding Japanese Patent Application No. 2018-102428 [English instructions, original document as filed in Japanese and attached references], (Part 3 of 3, 82 pages of 583 pages).
U.S. Appl. No. 15/331,742, filed Oct. 21, 2016, 2017/0095552, Apr. 6, 2017.
U.S. Appl. No. 15/910,525, filed Mar. 2, 2018, 2018/0195050, Jul. 12, 2018.
U.S. Appl. No. 15/109,214, filed Jun. 30, 2016, 2016/0339066, Nov. 24, 2016.
Letter/Written Disclosure of the Supplemental Information Disclosure Statement for the above-referenced application, filed herewith on Feb. 20, 2019, 2 pages.
Examiner's Report, dated Dec. 18, 2018, in connection with corresponding Canadian Patent Application No. 2,836,299, 5 pages.
Communication under Rule 71(3) EPC (Intention to Grant), dated Dec. 4, 2018, in connection with corresponding European Patent Application No. 12 716 971.2, 7 pages.
Response, filed Jan. 15, 2019, to Office Action, dated Oct. 16, 2018, in connection with corresponding Japanese Patent Application No. 2018-102428 [English instructions; response as filed in Japanese including five cited references (Al'tshtein et al., "Isolation of a recombinant vaccinia virus based on the LIVP strain inducing a surface antigen of the hepatitis B virus," Dokl. Akad. Nauk. SSSR 285(3):696-699 (1985) [Article in Russian with English language translation]; Fenner et al., "Chapter 11: Smallpox vaccine and vaccination in the intensified smallpox eradication programme," in Smallpox and its eradication, Geneva: World Health Organization, pp. 539-540 and 582 (1988); Shvalov et al., "Complete Genome Sequence of Vaccinia Virus Strain L-IVP," Genome Announcements 4(3):e00372-16 (2016); Meyer et al., "Summary report on first, second and third generation smallpox vaccines," World Health Organization, pp. 1 and 4 (2013); and Parrino, J. and B.S. Graham, "Smallpox vaccines: Past, present, and future," J Allergy Clin. Immunol. 118(6):1320-1326 (2006)) with Japanese translations of the relevant parts of each; and English translation of the amended claims], 47 pages.
Decision to Grant, dated Feb. 5, 2019, in connection with corresponding Japanese Patent Application No. 2018-102428 [English reporting letter and original document in Japanese], 4 pages.
Letter/Written Disclosure of the Supplemental Information Disclosure Statement for the above-referenced application, filed herewith on Sep. 4, 2019, 2 pages.
Response, filed Jun. 5, 2019, to Examiner's Report, dated Dec. 18, 2018, in connection with corresponding Canadian Patent Application No. 2,836,299, 54 pages.
Letter/Written Disclosure of the Supplemental Information Disclosure Statement for the above-referenced application, filed herewith on Sep. 21, 2020, 3 pages.
Notification of Reexamination, dated Jul. 29, 2020, in connection with corresponding Chinese Patent Application No. 201280029139.8 [English translation and original document in Chinese], 22 pages.
Letter/Written Disclosure of the Supplemental Information Disclosure Statement for the above-referenced application, filed herewith on Jun. 30, 2020, 3 pages.
Examiner's Report, dated Apr. 2, 2020, in connection with corresponding Canadian Patent Application No. 2,836,299, 6 pages.
Letter/Written Disclosure of the Supplemental Information Disclosure Statement for the above-referenced application, filed herewith on Feb. 23, 2021, 3 pages.
Decision of Reexamination, dated Feb. 7, 2021, in connection with corresponding Chinese Patent Application No. 201280029139.8 [English translation of Decision of Reexamination; original Decision of Reexaminaion as issued in Chinese; and Response filed Nov. 13, 2020 to Notification of Re-examination dated Jul. 29, 2020, including English instructions for response and original response as filed in Chinese], 83 pages.

CLONAL STRAINS OF ATTENUATED VACCINIA VIRUSES AND METHODS OF USE THEREOF

RELATED APPLICATIONS

Benefit of priority is claimed to U.S. Provisional Application Ser. No. 61/517,297, filed Apr. 15, 2011, and to U.S. Provisional Application Ser. No. 61/628,684, filed Nov. 4, 2011, each to Aladar A. Szalay, Nanhai Chen, Yong A. Yu and Qian Zhang and each entitled "Clonal Strains of Attenuated Vaccinia Viruses and Methods of Use Thereof."

This application is related to International PCT Application Serial No. PCT/US12/033684, filed the same day herewith, entitled "Clonal Strains of Attenuated Vaccinia Viruses and Methods of Use Thereof," which claims priority to U.S. Provisional Application Ser. Nos. 61/517,297 and 61/628,684.

Where permitted, the subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 Replacement and Copy #2 Replacement), the contents of which are incorporated by reference in their entirety. The computer-readable file on each of the aforementioned compact discs, created on Jun. 19, 2012, is identical, 4.44 megabytes in size, and titled 4832seq.002.txt.

FIELD OF THE INVENTION

Vaccinia viral isolates.

BACKGROUND

Vaccinia is an oncolytic virus and accumulates in tumors. Attenuated vaccinia virus strains have been developed for therapeutic and diagnostic applications. For example, attenuated viruses include recombinant viruses that are modified in one or more viral genes that results in loss or reduced expression of a viral gene or inactivation of a viral protein. Methods of attenuating viruses, however, can decrease or reduce the oncolytic properties of the virus. Thus, there still exists a need for attenuated oncolytic viruses and methods for producing attenuated oncolytic viruses.

SUMMARY

Provided are isolated clonal strains from LIVP preparations. Provided are preparations of substantially homogenous LIVP virus preparations. Also provided are preparations resulting from propagation of an isolated clonal strain. In particular, provided herein are isolated clonal LIVP strains that have a genome containing a sequence of nucleotides other than a clonal strain whose genome contains the sequence of nucleotides set forth in SEQ ID NO:10. In some examples, the LIVP clonal strains provided herein have a sequence of nucleotides that has at least 85% sequence identity with the sequence of nucleotides set forth in SEQ ID NO:10 but does not include the sequence of nucleotides set forth in SEQ ID NO: 10. For example, the isolated clonal LIVP strains provided herein have a sequence of nucleotides that has at least 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% sequence identity with the sequence of nucleotides set forth in SEQ ID NO:10. In such examples, sequence identity refers to sequence identity that is determined by aligning nucleotide sequences containing nucleotides corresponding to the inverted terminal repetitions (ITRs) (if they are present) and using global alignment with GAP, whereby terminal gaps are not penalized. In particular, the LIVP clonal strains provided herein have greater anti-tumorigenicity and/or reduced toxicity compared to the LIVP strain designated GLV-1h68 having a sequence of nucleotides set forth in SEQ ID NO: 9.

In examples of the LIVP clonal strains provided herein, an isolated clonal LIVP strain is one that is present in an LIVP isolate or in a virus preparation propagated from LIVP and the clonal strain has reduced toxicity and/or greater anti-tumorigenicity compared to the virus strain designated GLV-1h68 having a sequence of nucleotides set forth in SEQ ID NO:9.

In other examples of the LIVP clonal strains provided herein, an isolated clonal LIVP strain is one that has a genome that does not contain non-viral heterologous nucleic acid that contains an open reading frame encoding a non-viral heterologous protein and exhibits reduced toxicity and/or improved anti-tumorigencity compared to the virus strain designated GLV-1h68 having a sequence of nucleotides set forth in SEQ ID NO:9.

LIVP clonal strains provided herein include clonal strains that have reduced toxicity compared to the virus designated GLV-1 h68 having a sequence of nucleotides set forth in SEQ ID NO:9. In other examples, LIVP clonal strains provided herein include clonal strains that have greater anti-tumorigencity compared to the virus strain designated GLV-1h68 having a sequence of nucleotides set forth in SEQ ID NO:9. In further examples, LIVP clonal strains provided herein include clonal strains that have reduced toxicity and greater anti-tumorigenicity compared to the virus designated GLV-1h68 having a sequence of nucleotides set forth in SEQ ID NO:9.

In any of the LIVP clonal strains provided herein, the genome of the LIVP clonal strain has a sequence of nucleotides that is at least 85% sequence identity with the sequence of nucleotides set forth in SEQ ID NO:10 but does not contain the complete sequence of nucleotides set forth in SEQ ID NO:10. For example, the isolated clonal LIVP strain has a sequence of nucleotides that has at least 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% sequence identity. In such examples, sequence identity is determined by alignment of nucleotide sequences containing nucleotides corresponding to the inverted terminal repetitions (ITRs) and using global alignment with GAP with the sequence of nucleotides set forth in SEQ ID NO:10, whereby terminal gaps are not penalized.

In any of the provided LIVP clonal strains that exhibit reduced toxicity, reduced toxicity can be manifested upon administration to a subject. For example, the subject can be a human or non-human animal, particularly a domesticated animal. Reduced toxicity can be determined by any method for assessing a toxic effect, such as, but not limited to, a parameter indicative of toxicity such as decreased survival of the subject, decreased body weight, fever, rash, allergy, fatigue, abdominal pain, induction of an immune response in the subject, pock formation and/or lesser accumulation of the virus in non-tumor tissues to a greater extent that LIVP (a virus with the genome set forth in or substantially as set forth in, typically at least 99%, SEQ ID NO:10) or GLV-1h68 (a virus with the genome set forth in substantially as set forth in typically at least 99%, SEQ ID NO:9). Accumulation can be detected by any suitable method, such as imaging the subject to detect virus accumulation, particular in instances in which the virus expresses a detectable protein or a protein that induces a detectable signal or other such marker. Accumulation also can be detected by sampling body tissues and/or fluids. In some examples, reduced toxicity means that the subject experiences less toxic effects or no toxic effects compared to a subject administered with a virus designated GLV-1h68 having a sequence of nucleotides set forth in SEQ ID NO:9, whereby the virus designated GLV-1h68 is administered in similar amount and under the same dosage regime as the clonal strain. In other examples, reduced toxicity means that the subject does not die from toxic effects induced upon administration of the virus.

In some instances the LIVP clonal strain exhibits reduced toxicity and also greater anti-tumor activity, or a combination thereof than the reference LIVP strain, such as the strain with the genome set forth in SEQ ID NO:9, particularly, the strain designated GLV-1h68, also known as GL-ONC1. With any of the provided LIVP clonal strains that exhibit greater anti-tumorigenicity, anti-tumorigenicity can be manifested or assessed in vitro or in vivo upon administration to a subject. The greater anti-tumorigenicity can be determined by assessing in vitro or in vivo a parameter indicative of anti-tumorigenicity selected, for example, from among infectivity of tumor cells, accumulation of virus in tumor tissues, viral nucleic acid replication, virus production, viral gene expression, effects on the host cell, cytotoxicity, tumor cell selectivity, tumor cell type selectivity, immunogenicity and the amount of replication in tumor cells. In some examples, greater anti-tumorigenicity means that the clonal strain exhibits at least or about at least or 110%, 120%, 130%, 140%, 150%, 160%, 170%, 180%, 190%, 200%, 250%, 300%, 400%, 500%, 600%, 700%, 800% or more anti-tumorigenicity in an in vitro or in vivo assay assessing a parameter indicative of anti-tumorigenicity, such as change in tumor size in a given period of time, compared to the anti-tumorigenicity of a virus designated GLV-1h68 having a sequence of nucleotides set forth in SEQ ID NO:9 as assessed in the same assay under the same or similar conditions.

The LIVP clonal strains provided herein include any that differs in one or more nucleotides in an open reading frame (ORF) compared to the sequence of nucleotides of the corresponding ORF in the sequence of nucleotides set forth in SEQ ID NO: 10. Others can differ in other regions. For example, the difference in one or more nucleotides is one or more nucleotide deletions, substitutions or additions (i.e. insertions), particularly nucleotide changes that change the sequence of the encoded protein. In another example, the difference is a deletion, substitution or addition of one or more nucleotides in the promoter region of an ORF. In further examples, an ORF that differs from the corresponding ORF in the sequence of nucleotides set forth in SEQ ID NO:10 encodes a truncated protein, an inactive protein or eliminates production of the protein by the virus. In any of the above examples, the difference can be in an ORF selected from among an ORF designated g1001/290, g1009/283, g1010/282, g1011/280, g1015, g1032, g1034, g1035, g1037, g1069, g1077, g1079, g1082, g1084, g1088, g1093, g1225, g1230, g1239, g1241, g1257, g1264, g1270, g1273, g1274, g1277/105, g1280/010 and g1283/009. There can be a plurality of differences. Knowledge of the precise differences is not necessary, rather the strain is one that exhibits reduced toxicity and/or anti-tumor activity or a combination of both that renders the virus superior in properties as a tumor treatment or diagnostic to GLV-1h68 (i.e., either because one of the properties is substantially better or because the combination of properties is improved compared to the properties of GLV-1h68).

As exemplary of clonal strains, provided herein are LIVP clonal strains that contain a sequence of nucleotides 10,073-180,095 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7 or nucleotides 6,899-181,870 of SEQ ID NO:8. Also provided herein are LIVP clonal strains that contain a sequence of nucleotides that has at least about or at least 99% sequence identity to a sequence of nucleotides 10,073-180,095 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7 or nucleotides 6,899-181,870 of SEQ ID NO:8.

In other examples, the LIVP clonal strains provided herein contain a sequence of nucleotides that includes a left and/or right inverted terminal repeat. For example, provided herein are LIVP clonal strains that contain a sequence of nucleotides set forth in SEQ ID NOS: 1, 2, 4, 5, 6, 7 or 8. Also provided herein are LIVP clonal strains that contain a sequence of nucleotides that has at least 99% sequence identity to a sequence of nucleotides set forth in SEQ ID NO: 1, 2, 4, 5, 6, 7 or 8. Among LIVP clonal strains provided herein are LIVP clonal strains that contain a sequence of nucleotides set forth in SEQ ID NO:1 or a sequence of nucleotides that has at least 99% sequence identity to a sequence of nucleotides set forth in SEQ ID NO:1. In other examples, among LIVP clonal strains provided herein are LIVP clonal strains that contain a sequence of nucleotides set forth in SEQ ID NO:5 or a sequence of nucleotides that has at least 99% sequence identity to a sequence of nucleotides set forth in SEQ ID NO:5. In any of the examples of LIVP clonal strains provided herein, the LIVP clonal strain can be obtained by isolating an LIVP clone from a cell culture in which a strain having a sequence of nucleotides set forth in SEQ ID NOS: 1, 2, 4, 5, 6, 7 or 8, or a sequence of nucleotides that has at least 99% sequence identity to a sequence of nucleotides set forth in SEQ ID NO: 1, 2, 4, 5, 6, 7 or 8 has been propagated.

Provided herein is an LIVP virus preparation or virus that contains a genome of any of the above LIVP clonal strains provided herein.

Provided herein are recombinant or modified LIVP virus strains that contain a genome of any of the above LIVP clonal strains that are modified to also contain heterologous nucleic acid in the genome, such as nucleic acid encoding a heterologous gene product. In some examples, the heterologous nucleic acid, such as that encoding a heterologous gene product, is inserted into or in place of a non-essential gene or region in the genome of the virus. For example, the nucleic acid encoding the heterologous gene product is inserted at the hemagglutinin (HA), thymidine kinase (TK), F14.5L, vaccinia growth factor (VGF), A35R, NIL, E2L/E3L, K1L/K2L, superoxide dismutase locus, 7.5K, C7-K1L, B13R+B14R, A26L or I4L gene loci in the genome of the virus. The viruses provided herein can be modified as and/or used in any methods, such as treatment of tumors, vaccines against pathogens from antigens are inserted in the genome, for diagnosis and for diagnosis and treatment, known to those of skill in the art, including the modifications and methods/uses described, for example, in any of International PCT application No. WO 2009/054996, International PCT application No. WO 2009/139921, U.S. Publication Nos. US-2009-0081639, US-2009-0053244, US-2009-0098529, and U.S. Pat. Nos. 7,754,221, 7,588,767, 7,588,771 and 7,662,398.

In the recombinant or modified LIVP virus strains provided herein, heterologous gene products include one or a plurality of therapeutic and/or diagnostic agents or reagents. In some examples, the heterologous gene product is an anticancer agent, an antimetastatic agent, an antiangiogenic agent, an immunomodulatory molecule, an antigen, a cell matrix degradative gene, genes for tissue regeneration and reprogramming human somatic cells to pluripotency, enzymes that modify a substrate to produce a detectable product or signal or are detectable by antibodies, proteins that can bind a contrasting agent, genes for optical imaging or detection, genes for PET imaging and genes for MRI imaging. For example, the antimetastatic agent is one that inhibits metastatic colonization or inhibits cell invasion in an in vitro cell invasion assay. In another example, the antiangiogenic agent is one that inhibits blood vessel formation in a tumor. In further examples, the gene for tissue regeneration and reprogramming human somatic cells to pluripotency is a newt AG (nAG), Oct4, NANOG, Ngn3, Pdx1 or Mafa.

In examples of a recombinant or modified LIVP virus strain provided herein, a heterologous gene product is a therapeutic agent selected from among a hormone, a growth factor, cytokine, a chemokine, a costimulatory molecule, ribozymes, a transporter protein, a single chain antibody, an antisense RNA, a prodrug converting enzyme, an si RNA, a microRNA, a toxin, an antitumor oligopeptide, a mitosis inhibitor protein, an antimitotic oligopeptide, an anti-cancer polypeptide antibiotic, an angiogenesis inhibitor, a tumor suppressor, a cytotoxic protein, a cytostatic protein and a tissue factor. For example, the heterologous gene product is a granulocyte macrophage colony stimulating factor (GM-CSF), monocyte chemotactic protein-1 (MCP-1), interleukin-6 (IL-6), interleukin-24 (IL-24), interferon gamma-induced protein 10 (IP-10), lymphotoxin inducible expression competes with HSV glycoprotein D for HVEM a receptor expressed on T-lymphocytes (LIGHT), p60 superantigen, OspF, OspG, signal transducer and activator of transcription protein (STAT1alpha), STAT1beta, plasminogen k5 domain (hK5), pigment epithelium-differentiation factor (PEDF), single chain anti-VEGF antibody, single chain anti-DLL4 antibody, single chain anti-fibroblast activation protein (FAP), NM23, cadherin 1 (ECAD or cdh1), relaxin 1 (RLN1), matrix metallopeptidase 9 (MMP9), erythropoietin (EPO), microRNA126 (miR-126), microRNA 181, microRNA 335, manganese superoxide dismutase (MnSOD), E3 ubiquitin protein ligase 1 (HACE1), natriuretic peptide precursor A (nppa1), carboxypeptidase G2 (CPG2), alcohol dehydrogenase (ADH), $CDCl_6$, or bone morphogenetic protein 4 (BMP4). For example, the the single chain anti-VEGF antibody is designated G6.

In examples of a recombinant or modified LIVP strain herein that contains a heterologous gene product encoding a diagnostic agent, the diagnostic agent is a detectable protein or a protein that induces a detectable signal. For example, the diagnostic agent is a luciferase, a fluorescent protein, a bioluminescent protein, a receptor or transporter protein that binds to and/or transports a contrast agent, chromophore, compound or ligand that can be detected. In such examples, the receptor or transporter protein that binds to and/or transports a contrast agent is an iron receptor, an iron transporter, or a copper uptake transporter. In particular examples, the diagnostic agent is a green click beetle luciferase, a lux operon, an infrared fluorescent protein, a flavin reductase protein, mNeptune far-red fluorescent protein, green fluorescent protein (GFP), red fluorescent protein (RFP), coelenterazine-binding protein (CBP), human epinephrine receptor (hNET), a sodium iodide symporter (NIS) protein, a cytochrome p450 family enzyme, allostatin A receptor (AlstR), Pep1 Receptor (PEPR-1), LAT-4, sterol 14 alpha-demethylase (Cyp51), transferring receptor (TR), ferritin, divalent metal transporter (DMT), Magnetotactic A (MagA) or cisplatin influx transporter (CTR1).

In the recombinant or modified LIVP virus strains provided herein, the nucleic acid encoding the heterologous gene product is operably linked to a promoter. For example, the promoter is a mammalian promoter, including viral promoters. In some examples, the promoter is a $P_{7.5k}$, $P_{11k}$, $P_{SE}$, $P_{SEL}$, $P_{SL}$, H5R, TK, P28, C11R, G8R, F17R, I3L, I8R, A1L, A2L, A3L, H1L, H3L, H5L, H6R, H8R, D1R, D4R, D5R, D9R, D11L, D12L, D13L, M1L, N2L, P4b or K1 promoters.

Provided herein is a composition containing any of the clonal strains or virus strains provided herein above. Also provided herein is a pharmaceutical composition containing any of the clonal strains or virus strains provided herein above. In other examples, the composition or pharmaceutical composition provided herein can contain one or more different virus strains. In some examples, the pharmaceutical composition contains a pharmaceutically acceptable carrier. The pharmaceutical compositions provided herein can be formulated for local or systemic administration. In other examples, the pharmaceutical composition is formulated for administration as an antiviral or anticancer vaccine or anticancer therapeutic.

Provided herein is a combination containing any of the clonal strains or virus strains provided herein and a therapeutic or diagnostic agent. In some examples, the therapeutic agent is selected from among a chemotherapeutic agent, an immunosuppressive agent and an antiviral agent. For example, the chemotherapeutic agent is an antimetastatic agent or an antiangiogenic agent. In some examples, the chemotherapeutic agent is a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine or therapeutic, an anti-cancer oligopeptide, a mitosis inhibitor protein, an antimitotic oligopeptide, an anticancer antibody, an anti-cancer antibiotic, an immunotherapeutic agent or a combination of any of the preceding thereof. In other examples, the chemotherapeutic agent is cisplatin, carboplatin, gemcitabine, irinotecan, an anti-EGFR antibody or an anti-VEGF antibody. In some examples, the immunosuppressive agent is a glucocorticoid, an alkylating agent, an antimetabolite, or an antibody. In other examples, the antiviral agent is cidofovir, Gleevec® (Imatinib), ganciclovir, acyclovir or ST-246. For example, the antiviral agent is a chemotherapeutic agent. In any of the examples provided herein to a combination, the virus and the chemotherapeutic and/or antiviral agent are formulated as a single composition or separately in two or more compositions.

Provided herein is a kit containing any of the above LIVP virus strain, any of the above compositions or pharmaceutical compositions or any of the above combinations, and optionally instructions for administration of the composition.

Provided herein is a method, use or composition for use in treating a proliferative disorder in a subject by administering any of the above pharmaceutical compositions, for example, any of the above pharmaceutical compositions containing any of the clonal strains or virus strains provided herein. The proliferative disease can be a cancer. For example, the cancer can be breast cancer, prostate cancer, ovarian cancer, lung cancer, colon cancer or pancreatic cancer. The proliferative disorder can be a tumor or a metastasis. In the methods herein, the subject can be a human or a non-human subject.

In examples of the methods, uses or compositions for use herein for treating a proliferative disorder, the virus can be administered or can be formulated in an amount that is at least or about or $1 \times 10^5$ pfu at least one time over a cycle of administration. For example, the virus is administered or is formulated in an amount that is at least or at least about or is $1 \times 10^5$ pfu, $1 \times 10^6$ pfu, $1 \times 10^7$ pfu, $1 \times 10^8$ pfu, $1 \times 10^9$ pfu, $1 \times 10^{10}$ pfu, $1 \times 10^{11}$ pfu, $1 \times 10^{12}$ fu p, $1 \times 10^{13}$ pfu, or $1 \times 10^{14}$ pfu at least one time or at least once over a cycle of administration. For example, the concentration of the virus strain in a formulation for the methods, uses, or compositions for use herein can be $1 \times 10^6$-$1 \times 10^{16}$ pfu/ml or is at least or is about or $1 \times 10^6$ pfu/ml, $1 \times 10^7$ pfu/ml, $1 \times 10^8$ pfu/ml, $1 \times 10^9$ pfu/ml, $1 \times 10^{10}$ pfu/ml, $1 \times 10^{11}$ pfu/ml, $1 \times 10^{12}$ pfu/ml, $1 \times 10^{13}$ pfu/ml, $1 \times 10^{14}$ pfu/ml, $1 \times 10^{15}$ pfu/ml, or $1 \times 10^{16}$ pfu/ml. In such examples, the amount of virus is administered two times, three times, four times, five times, six times or seven times over the cycle of administration. For example, the amount of virus is administered on the first day of the cycle, the first and second day of the cycle, each of the first three consecutive days of the cycle, each of the first four consecutive days of the cycle, each of the first five consecutive days of the cycle, each of the first six consecutive days of the cycle, or each of the first seven consecutive days of the cycle. The cycle of administration can be 7 days, 14 days, 21 days or 28 days.

In the methods herein, a second therapeutic agent for the treatment of the proliferative disorder can also be administered. It can be administered with the virus, separately, sequentially or intermittently. One of skill in the art is familiar with various therapeutic agents for the treatments of proliferative disorders, such as cancer. For example, in the methods herein, further treatments for proliferative disorders include, but are not limited to, surgery, radiation therapy, immunosuppressive therapy, or administration of an anti-cancer agent. For example, anticancer agents include a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine or treatment, an anti-cancer oligopeptide, a mitosis inhibitor protein, an antimitotic oligopeptide, an anticancer antibody, an anti-cancer antibiotic, an immunotherapeutic agent or a combination of any of the preceding thereof. The anticancer agent can be a cisplatin, carboplatin, gemcitabine, irinotecan, an anti-EGFR antibody or an anti-VEGF antibody. In such examples, the virus and the anticancer agent are administered sequentially, simultaneously, or intermittently.

In the methods or uses herein above, including, but not limited to, for treating a proliferative disorder, the virus is administered locally, topically or systemically, including intravenously, intraarterially, intratumorally, endoscopically, intralesionally, intramuscularly, intradermally, intraperitoneally, intravesicularly, intraarticularly, intrapleurally, percutaneously, subcutaneously, orally, parenterally, intranasally, intratracheally, by inhalation, intracranially, intraprostatically, intravitreally, topically, ocularly, vaginally, or rectally. For example, the virus is administered intravenously or intraperitoneally.

Provided herein are methods for detecting a tumor or metastasis in a subject by administering to a subject any of the LIVP virus or clonal strain provided herein or a composition or pharmaceutical composition containing any of the LIVP virus strains or clonal strains provided herein. For diagnosis or detection, the virus contains nucleic acid encoding a detectable protein or a protein that induces a detectable signal, and detecting the detectable protein or a protein that induces a detectable signal, whereby detection indicates the presence of the tumor or metastasis in the subject. In the method for detection herein, the detectable protein or protein that induces a detectable signal is selected from among a luciferase, a fluorescent protein, a bioluminescent protein, a receptor or transporter protein that binds to and/or transports a contrast agent, chromophore, compound or ligand that can be detected. For example, the detectable protein or protein that induces a detectable signal is a green fluorescent protein (GFP), red fluorescent protein (RFP), an iron receptor, an iron transporter, a sodium or other ion transporter, such as the human epinephrine receptor (hNET) or a sodium iodide symporter (NIS) protein. In the methods for detection provided herein, the detectable protein or detectable signal is detected by low-light imaging, fluorescence spectroscopy, x-ray imaging, magnetic resonance imaging (MRI), magnetic resonance spectroscopy (MRS), positron emission tomography (PET) or single-photon emission computed tomography (SPECT).

Provided herein is a method of detecting virus activity in a host by administering any of the LIVP virus or clonal strain provided herein to a subject. The virus contains nucleic acid encoding a detectable protein or a protein that induces a detectable signal and detecting the detectable protein or a protein that induces a detectable signal, whereby detection indicates the virus is active or has oncolytic activity. In such examples, the subject has a tumor or cancer. In examples of the method, the step of detecting the detectable protein or a protein that induces a detectable signal is from a body fluid sample from the subject. For example, the body fluid is urine, blood, tear or cerebrospinal fluid.

Provided herein is a host cell containing any of the LIVP virus strains or clonal strains provided herein.

Provided herein is a method of selecting an LIVP clonal strain for cancer therapy and diagnosis by (i) providing a first LIVP virus sample that contains a mixture of virus particles with different genomic sequences; (ii) selecting and isolating single clonal isolates from the sample; (iii) assaying each clonal isolate for toxicity; (iv) assaying each clonal isolate for anti-tumorigenicity; and (v) selecting a clonal strain that exhibits greater anti-tumorigenicity and reduced toxicity compared to a reference LIVP virus strain, whereby the clonal isolates that exhibit reduced toxicity and greater anti-tumorigenicity are identified as LIVP clonal strains for cancer therapy or diagnosis. In the method of selecting an LIVP clonal strain herein, the reference LIVP virus can be the first LIVP virus sample. In some examples, the reference LIVP virus is an attenuated recombinant LIVP virus. For example, the reference LIVP virus is the virus designated GLV-1h68 whose genome has the sequence of nucleotides set forth in SEQ ID NO: 9 (GLV-1h68).

In methods of selecting or identifying an LIVP clonal strain provided herein, the first LIVP virus sample can be an LIVP virus strain that has an LIVP having a genome set forth in SEQ ID NO:10, or a genome that is at least 99% identical to SEQ ID NO:10 or any other the other strains provided herein. In other examples, the first LIVP virus sample is a mixture obtained by propagation of cells infected with a LIVP strain and another virus strain, genomic DNA or cloned DNA, followed by isolation of a sample of viruses from the culture, wherein the sample comprises progeny viruses produced by the infection. For example, the other virus strain can be a DNA virus, double-stranded RNA virus, a single-stranded positive sense RNA virus or a single-stranded negative sense RNA virus. The DNA virus can be a poxvirus, such as avipox virus, myxoma virus or vaccinia virus; a herpesvirus such as herpes simplex virus (HSV), cytomegalovirus (CMV), Epstein-Barr virus (EBV), hepadnaviruses (e.g., hepatitis B virus), polyoma viruses, papillomaviruses, adenoviruses and adeno-associated viruses; or single-stranded DNA viruses, such as parvoviruses. For example, the other virus strain is a vaccinia strain. In some examples the other virus is a double-stranded RNA virus, the double-stranded RNA virus is a reovirus such as rotavirus. In examples, wherein the other virus is a single-stranded positive sense RNA virus, the single-stranded positive sense RNA virus is a picornoviruses such as Seneca valley virus, coxsackievirus or poliovirus, enteroviruses; togaviruses such as semliki forest virus; and retroviruses such as human immunodeficiency virus (HIV), murine Maloney leukemia virus (MMLV) or lentiviruses. In further examples, wherein the other virus is a single-stranded negative sense RNA virus, the single-stranded negative sense RNA virus is an orthomyxovirus such as influenza virus; paramyxoviruses such as Newcastle disease virus, measles virus or mumps virus; or rhabdoviruses such as vesicular stomatitis virus (VSV).

In the methods herein of selecting or identifying a clonal strain, the step of selecting single clonal isolates from the sample can be performed by a plaque assay. For example, the largest plaques in the plaque assay are selected. In such examples, the largest 2, 3, 4, 5, 6, 7, 8, 9, 10, 11, 12, 13, 14, 15, 16, 17, 18, 19, 20 can be selected and isolated as a clonal isolate and each assayed for toxicity and anti-tumorigenicity in steps (iii) and (iv) of the method. In other examples, the plaque that is selected is larger than the average plaque size of the plaques produced by the LIVP virus sample.

In the methods provided herein of selecting a clonal strain, in step iii) toxicity is assessed in vivo upon administration of a selected clonal isolate to a first subject and administration of the reference virus to a second subject, wherein the first and second subject are of the same species, size and gender and the virus is administered in the same or similar amount and under the same or similar dosage regime to each subject; and a parameter indicative of toxicity is assessed and measured in the subjects as an indicator of the toxic effect. For example, the parameter indicative of toxicity is decreased or reduced survival of the subject, decrease in body weight, fever, rash, allergy, fatigue, abdominal pain, induction of an immune response in the subject or pock formation. In the methods herein of selecting a clonal strain, in step v) selecting a virus that exhibits reduced toxicity includes a) comparing the measured parameter indicative of toxicity between the first subject and the second subject; and b) identifying or selecting a clonal isolate that exhibits a reduced toxic effect compared to the toxic effect exhibited by the reference virus. For example, a clonal isolate that exhibits reduced toxicity is one that results in no decreased weight of the first subject or a reduced decreased weight of the first subject compared to the second subject. In other examples, a clonal isolate that exhibits reduced toxicity is one that exhibits increased survival of the first subject over the course of treatment compared to the second subject. In additional examples, a clonal isolate is selected that exhibits reduced toxicity is one that does not result in death of the subject over the course of treatment.

In the methods provided herein of selecting a clonal virus strain, in step iv) anti-tumorigenicity of a selected clonal isolate and the reference virus is assessed in vitro or in vivo upon administration to a subject; and a parameter indicative of anti-tumorigenicity is assessed and measured. For example, when assessing anti-tumorigenicity in vivo upon administration a selected clonal isolate is administered to a first subject and the reference virus is administered to a second subject, wherein the first and second subject are of the same species, size and gender and the virus is administered in the same or similar amount and under the same or similar dosage regime to each subject. The parameter indicative of anti-tumorigenicity can include infectivity of tumor cells, accumulation of virus in tumor tissues, viral nucleic acid replication in tumor cells, virus production in tumor cells, viral gene expression in tumor cells, cytotoxicity of tumor cells, tumor cell selectivity, tumor cell type selectivity, decreased tumor size, increased tumor volume, decreased tumor weight, or initiation of specific and non-specific anti-tumor immune responses. In the methods provided herein of selecting a clonal virus strain, in step v) selecting a virus that exhibits greater anti-tumorigenicity includes c) comparing the measured parameter indicative of anti-tumorigenicity exhibited by selected clonal isolate and the reference virus; and d) identifying or selecting a clonal isolate that exhibits a greater anti-tumorigenicity compared to the anti-tumorigenicity exhibited by the reference virus. For example, greater anti-tumorigenicity means that the clonal isolate exhibits at least or about at least or 120%, 130%, 140%, 150%, 160%, 170%, 180%, 190%, 200%, 250%, 300%, 400%, 500%, 600%, 700%, 800% or more anti-tumorigenicity in an in vitro or in vivo assay assessing a parameter indicative of anti-tumorigenicity compared to the anti-tumorigenicity of the reference virus as assessed in the same assay under the same or similar conditions.

In the methods herein of selecting a clonal virus strain, the step of assessing toxicity or anti-tumorigencity in vivo upon administration to a subject is to a subject that is a non-human animal or is a human. In the methods herein, the subject can have a tumor or cancer. For example, the tumor is a breast tumor, prostate tumor, ovarian tumor, lung tumor, colon tumor, or pancreatic tumor. The tumor can be a xenograft, allograft, or spontaneous/natural tumor.

In the methods herein of selecting a clonal virus strain, the genome of the selected clonal strain can be analyzed to assess the homogeneity of sequence, such that only those isolates that have a homogenous genome sequence are selected. For example, the genome is analyzed by a method such as sequencing, restriction analysis, PCR, Southern Blot or protein expression.

Provided herein is a clonal strain that is produced or selected by any of the methods herein of selecting a clonal strain.

DETAILED DESCRIPTION

Outline

A. Definitions
B. Methods of Isolating Clonal Vaccinia Virus Strains
1. Parental Virus Preparation or Mixture
2. Isolating Clonal Strains 3. Anti-Tumorigenicity
   a. Tumor-Associated Replication Indicator
   b. Cytotoxicity
   c. Tumor Growth
4. Toxicity/Safety
5. Genome Analysis
C. Isolated Clonal Virus Strains
1. LIVP
2. LIVP Clonal Strains
   Exemplary LIVP Clonal Strains
D. Modification of LIVP Strains
1. Heterologous Nucleic Acid
2. Exemplary Modifications
   a. Diagnostic gene products
   b. Therapeutic gene products
   c. Antigens
   d. Modifications to alter attenuation of the viruses
3. Control of heterologous gene expression
4. Methods for generating modified viruses
E. Propagation and Production of Viruses
1. Host cells for propagation
2. Concentration determination
3. Storage methods
4. Preparation of virus
F. Pharmaceutical Compositions, Combinations and Kits
1. Pharmaceutical compositions
2. Host cells
3. Combinations
4. Kits
G. Therapeutic, Diagnostic and Monitoring Methods
1. Therapeutic Methods
2. Diagnostic and Monitoring Methods
3. Administration
   a. Steps prior to administering the virus
   b. Mode of administration
   c. Dosages and Dosage Regime
   d. Co-administrations
      i. Administering a plurality of viruses
      ii. Therapeutic Compounds
      iii. Immunotherapies and biological therapies
   e. State of Subject
4. Monitoring
   a. Monitoring viral gene expression
   b. Monitoring tumor size
   c. Monitoring antibody titer
   d. Monitoring general health diagnostics
   e. Monitoring coordinated with treatment
H. Examples

A. DEFINITIONS

Unless defined otherwise, all technical and scientific terms used herein have the same meaning as is commonly understood by one of skill in the art to which the invention(s) belongs/belong. All patents, patent applications, published applications and publications, websites and other published materials referred to throughout the entire disclosure herein, unless noted otherwise, are incorporated by reference in their entirety. In the event that there are pluralities of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, Lister Strain of the Institute of Viral Preparations (LIVP) or LIVP virus strain refers to a virus strain that is the attenuated Lister strain (ATCC® Catalog No. VR-1549™) that was produced by adaption to calf skin at the Institute of Viral Preparations, Moscow, Russia (Al'tshtein et al. (1985) *Dokl. Akad. Nauk USSR* 285:696-699). The LIVP strain can be obtained, for example, from the Institute of Viral Preparations, Moscow, Russia (see. e.g., Kutinova et al. (1995) Vaccine 13:487-493); the Microorganism Collection of FSRI SRC VB Vector (Kozlova et al. (2010) Environ. Sci. Technol. 44:5121-5126); or can be obtained from the Moscow Ivanovsky Institute of Virology (C0355 K0602; Agranovski et al. (2006) Atmospheric Environment 40:3924-3929). It also is well known to those of skill in the art; it was the vaccine strain used for vaccination in the USSR and throughout Asia and India. The strain now is used by researchers and is well known (see e.g., Altshteyn et al. (1985) *Dokl. Akad. Nauk USSR* 285:696-699; Kutinova et al. (1994) *Arch. Virol.* 134:1-9; Kutinova et al. (1995) *Vaccine* 13:487-493; Shchelkunov et al. (1993) *Virus Research* 28:273-283; Sroller et al. (1998) *Archives Virology* 143:1311-1320; Zinoviev et al., (1994) *Gene* 147:209-214; and Chkheidze et al. (1993) *FEBS* 336:340-342). Among the LIVP strains is one that contains a genome having a sequence of nucleotides set forth in SEQ ID NO:10, or a sequence that is at least or at least about 99% identical to the sequence of nucleotides set forth in SEQ ID NO:10. An LIVP virus strain encompasses any virus strain or virus preparation that is obtained by propagation of LIVP through repeat passage in cell lines.

As used herein, an LIVP clonal strain or LIVP clonal isolate refers to a virus that is derived from the LIVP virus strain by plaque isolation, or other method in which a single clone is propagated, and that has a genome that is homogenous in sequence. Hence, an LIVP clonal strain includes a virus whose genome can be present in a virus preparation propagated from LIVP. An LIVP clonal strain does not include a recombinant LIVP virus that is genetically engineered by recombinant means using recombinant DNA methods to introduce heterologous nucleic acid. In particular, an LIVP clonal strain has a genome that does not contain heterologous nucleic acid that contains an open reading frame encoding a heterologous protein. For example, an LIVP clonal strain has a genome that does not contain non-viral heterologous nucleic acid that contains an open reading frame encoding a non-viral heterologous protein. As described herein, however, it is understood that any of the LIVP clonal strains provided herein can be modified in its genome by recombinant means to generate a recombinant virus. For example, an LIVP clonal strain can be modified to generate a recombinant LIVP virus that contains insertion of nucleotides that contain an open reading frame encoding a heterologous protein.

As used herein, LIVP 1.1.1 is an LIVP clonal strain that has a genome having a sequence of nucleotides set forth in SEQ ID NO:1, or a genome having a sequence of nucleotides that has at least 99% sequence identity to the sequence of nucleotides set forth in SEQ ID NO:1.

As used herein, LIVP 2.1.1 is an LIVP clonal strain that has a genome having a sequence of nucleotides set forth in SEQ ID NO:2, or a genome having a sequence of nucleotides that has at least 99% sequence identity to the sequence of nucleotides set forth in SEQ ID NO:2.

As used herein, LIVP 4.1.1 is an LIVP clonal strain that has a genome having a sequence of nucleotides set forth in SEQ ID NO:4, or a genome having a sequence of nucleotides that has at least 99% sequence identity to the sequence of nucleotides set forth in SEQ ID NO:4.

As used herein, LIVP 5.1.1 is an LIVP clonal strain that has a genome having a sequence of nucleotides set forth in SEQ ID NO:5, or a genome having a sequence of nucleotides that has at least 99% sequence identity to the sequence of nucleotides set forth in SEQ ID NO:5.

As used herein, LIVP 6.1.1 is an LIVP clonal strain that has a genome having a sequence of nucleotides set forth in SEQ ID NO:6, or a genome having a sequence of nucleotides that has at least 99% sequence identity to the sequence of nucleotides set forth in SEQ ID NO:6.

As used herein, LIVP 7.1.1 is an LIVP clonal strain that has a genome having a sequence of nucleotides set forth in SEQ ID NO:7, or a genome having a sequence of nucleotides that has at least 99% sequence identity to the sequence of nucleotides set forth in SEQ ID NO:7.

As used herein, LIVP 8.1.1 is an LIVP clonal strain that has a genome having a sequence of nucleotides set forth in SEQ ID NO:8, or a genome having a sequence of nucleotides that has at least 99% sequence identity to the sequence of nucleotides set forth in SEQ ID NO:8.

As used herein, a modified LIVP virus strain refers to an LIVP virus that has a genome that is not contained in LIVP, but is a virus that is produced by modification of a genome of a strain derived from LIVP. Typically, the genome of the virus is modified by substitution (replacement), insertion (addition) or deletion (truncation) of nucleotides. Modifications can be made using any method known to one of skill in the art such as genetic engineering and recombinant DNA methods. Hence, a modified virus is a virus that is altered in its genome compared to the genome of a parental virus. Exemplary modified viruses have one or more heterologous nucleic acid sequences inserted into the genome of the virus. Typically, the heterologous nucleic acid contains an open reading frame encoding a heterologous protein. For example, modified viruses herein can contain one or more heterologous nucleic acid sequences in the form of a gene expression cassette for the expression of a heterologous gene.

As used herein, "production by recombinant methods" or "methods using recombinant DNA methods" or variations thereof refers to the use of the well known methods of molecular biology for expressing proteins encoded by cloned DNA.

As used herein a "gene expression cassette" or "expression cassette" is a nucleic acid construct, containing nucleic acid elements that are capable of effecting expression of a gene in hosts that are compatible with such sequences. Expression cassettes include at least promoters and optionally, transcription termination signals. Typically, the expression cassette includes a nucleic acid to be transcribed operably linked to a promoter. Expression cassettes can contain genes that encode, for example, a therapeutic gene product, or a detectable protein or a selectable marker gene.

As used herein, LIVP GLV-1h68 is an LIVP virus that contains-ruc-gfp (a luciferase and green fluorescent protein fusion gene (see e.g. U.S. Pat. No. 5,976,796), beta-galactosidase (LacZ) and beta-glucuronidase (gusA) reporter genes inserted into the F14.5L, J2R (thymidine kinase) and A56R (hemagglutininin) loci, respectively. The genome of GLV-1h68 has a sequence of nucleotides set forth in SEQ ID NO:9, or a sequence of nucleotides that has at least 99% sequence identity to the sequence of nucleotides set forth in SEQ ID NO:9.

As used herein, a virus preparation, for example an LIVP virus preparation, refers to a virus composition obtained by propagation of a virus strain, for example an LIVP virus strain, an LIVP clonal strain or a modified or recombinant virus strain, in vivo or in vitro in a culture system. For example, an LIVP virus preparation refers to a viral composition obtained by propagation of a virus strain in host cells, typically upon purification from the culture system using standard methods known in the art. A virus preparation generally is made up of a number of virus particles or virions. If desired, the number of virus particles in the sample or preparation can be determined using a plaque assay to calculate the number of plaque forming units per sample unit volume (pfu/mL), assuming that each plaque formed is representative of one infective virus particle. Each virus particle or virion in a preparation can have the same genomic sequence compared to other virus particles (i.e. the preparation is homogenous in sequence) or can have different genomic sequences (i.e. the preparation is heterogenous in sequence). It is understood to those of skill in the art that, in the absence of clonal isolation, heterogeneity or diversity in the genome of a virus can occur as the virus resproduces, such as by homologous recombination events that occur in the natural selection processes of virus strains (Plotkin & Orenstein (eds) "Recombinant Vaccinia Virus Vaccines" in Vaccines, $3^{rd}$ edition (1999)).

As used herein, a virus mixture is a virus preparation that contains a number of virus particles that differ in their genomic sequences. The virus mixture can be obtained by infecting a culture system, for example host cells, with two or more different virus strains, or one virus strain and genomic DNA or cloned DNA, followed by propagation and purification of the resulting virus. For purposes herein, an LIVP virus preparation can include a virus mixture obtained by propagation of cells infected with a LIVP strain and another virus, genomic DNA or cloned DNA, followed by isolation of a virus preparation from the culture, where the preparation contains progeny viruses produced by the infection. For example, the other virus strain can be poxvirus, such as avipox virus, myxoma virus or other vaccinia virus; a herpesvirus such as herpes simplex virus (HSV), cytomegalovirus (CMV), Epstein-Barr virus (EBV), hepadnaviruses (e.g., hepatitis B virus), polyoma viruses, papillomaviruses, adenoviruses and adeno-associated viruses; and single-stranded DNA viruses, such as parvoviruses. The other virus can be an attenuated virus, oncolytic virus or other virus with known anti-tumor activity and/or moderate to mild toxicity.

As used herein, "virus" refers to any of a large group of infectious entities that cannot grow or replicate without a host cell. Viruses typically contain a protein coat surrounding an RNA or DNA core of genetic material, but no semipermeable membrane, and are capable of growth and multiplication only in living cells. Viruses include, but are not limited to, poxviruses, herpesviruses, adenoviruses, adeno-associated viruses, lentiviruses, retroviruses, rhabdoviruses, papillomaviruses, vesicular stomatitis virus, measles virus, Newcastle disease virus, picornavirus, sindbis virus, papillomavirus, parvovirus, reovirus, coxsackievirus, influenza virus, mumps virus, poliovirus, and semliki forest virus.

As used herein, oncolytic viruses refer to viruses that replicate selectively in tumor cells in tumorous subjects. Some oncolytic viruses can kill a tumor cell following infection of the tumor cell. For example, an oncolytic virus can cause death of the tumor cell by lysing the tumor cell or inducing cell death of the tumor cell.

As used herein, an "attenuated LIVP virus" with reference to LIVP refers to a virus that exhibits reduced or less virulence, toxicity or pathogenicity compared to LIVP.

As used herein, "toxicity" (also referred to as virulence or pathogenicity herein) with reference to a virus refers to the deleterious or toxic effects to a host upon administration of the virus. For an oncolytic virus, such as LIVP, the toxicity of a virus is associated with its accumulation in non-tumorous organs or tissues, which can impact the survival of the host or result in deleterious or toxic effects. Toxicity can be measured by assessing one or more parameters indicative of toxicity. These include accumulation in non-tumorous tissues and effects on viability or health of the subject to whom it has been administered, such as effects on weight.

As used herein, a "parameter indicative of toxicity" refers to a property mediated by a virus that is associated with its toxicity, virulence or pathogenicity. Parameters indicative of toxicity generally are assessed in vivo upon administration to a subject. Exemplary parameters indicative of toxicity include, but are not limited to, decreased survival of the subject, decreased body weight, fever, rash, allergy, fatigue, abdominal pain, induction of an immune response in the subject and pock formation. Assays or measures that assess any of the above parameters or other toxic properties known to one of skill in the art are described herein or are known to one of skill in the art. Hence, a virus that mediates any one or more of the above activities or properties in a host exhibits some degree of toxicity.

As used herein, "reduced toxicity" means that the toxic or deleterious effects upon administration of the virus to a host are attenuated or lessened compared to a host not treated with the virus or compared to a host that is administered with another reference or control virus. For purposes herein, exemplary of a reference or control virus is the LIVP virus designated GLV-1h68. Whether toxicity is reduced or lessened can be determined by assessing the effect of a virus and, if necessary, a control or reference virus, on a parameter indicative of toxicity. It is understood that when comparing the activity of two or more different viruses, the amount of virus (e.g. pfu) used in an in vitro assay or administered in vivo is the same or similar and the conditions (e.g. in vivo dosage regime) of the in vitro assay or in vivo assessment are the same or similar. For example, when comparing effects upon in vivo administration of a virus and a control or reference virus the subjects are the same species, size, gender and the virus is administered in the same or similar amount under the same or similar dosage regime. In particular, a virus with reduced toxicity can mean that upon administration of the virus to a host, such as for the treatment of a disease, the virus does not accumulate in non-tumorous organs and tissues in the host to an extent that results in damage or harm to the host, or that impacts survival of the host to a greater extent than the disease being treated does or to a greater extent than a control or reference virus does. For example, a virus with reduced toxicity includes a virus that does not result in death of the subject over the course of treatment.

As used herein, accumulation of a virus in a particular tissue refers to the distribution of the virus in particular tissues of a host organism after a time period following administration of the virus to the host, long enough for the virus to infect the host's organs or tissues. As one skilled in the art will recognize, the time period for infection of a virus will vary depending on the virus, the organ(s) or tissue(s), the immunocompetence of the host and dosage of the virus. Generally, accumulation can be determined at time points from about less than 1 day, about 1 day to about 2, 3, 4, 5, 6 or 7 days, about 1 week to about 2, 3 or 4 weeks, about 1 month to about 2, 3, 4, 5, 6 months or longer after infection with the virus. For purposes herein, the viruses preferentially accumulate in immunoprivileged tissue, such as inflamed tissue or tumor tissue, but are cleared from other tissues and organs, such as non-tumor tissues, in the host to the extent that toxicity of the virus is mild or tolerable and at most, not fatal.

As used herein, "preferential accumulation" refers to accumulation of a virus at a first location at a higher level than accumulation at a second location (i.e., the concentration of viral particles, or titer, at the first location is higher than the concentration of viral particles at the second location). Thus, a virus that preferentially accumulates in immunoprivileged tissue (tissue that is sheltered from the immune system), such as inflamed tissue, and tumor tissue, relative to normal tissues or organs, refers to a virus that accumulates in immunoprivileged tissue, such as tumor, at a higher level (i.e., concentration or viral titer) than the virus accumulates in normal tissues or organs.

As used herein, "anti-tumor activity" or "anti-tumorigenic" refers to virus strains that prevent or inhibit the formation or growth of tumors in vitro or in vivo in a subject. Anti-tumor activity can be determined by assessing a parameter or parameters indicative of anti-tumor activity.

As used herein, a "parameter indicative of anti-tumor activity or anti-tumorigenic activity" refers to a property mediated by a virus that is associated with anti-tumor activity. Parameters indicative of anti-tumor activity can be assessed in vitro or in vivo upon administration to a subject. Exemplary parameters indicative of anti-tumor activity include, but are not limited to, infectivity of tumor cells, accumulation of virus in tumor tissues, viral nucleic acid replication in tumor cells, virus production in tumor cells, viral gene expression in tumor cells, cytotoxicity of tumor cells, tumor cell selectivity, tumor cell type selectivity, decreased tumor size, increased tumor volume, decreased tumor weight, and initiation of specific and nonspecific anti-tumor immune responses. Assays that assess any of the above parameters or other anti-tumorigenic properties are known to one of skill in the art. Exemplary assays are described herein. Hence, a virus that exhibits any one or more of the above activities or properties exhibits anti-tumor activity.

As used herein, "greater" or "improved" activity with reference to anti-tumor activity or anti-tumorigenicity means that a virus strain is capable of preventing or inhibiting the formation or growth of tumors in vitro or in vivo in a subject to a greater extent than a reference or control virus or to a greater extent than absence of treatment with the virus. For purposes herein, exemplary of a reference or control virus is the LIVP virus designated GLV-1h68. Whether anti-tumor activity is "greater" or "improved" can be determined by assessing the effect of a virus and, if necessary, a control or reference virus, on a parameter indicative of anti-tumor activity. It is understood that when comparing the activity of two or more different viruses, the amount of virus (e.g. pfu) used in an in vitro assay or administered in vivo is the same or similar, and the conditions (e.g. in vivo dosage regime) of the in vitro assay or in vivo assessment are the same or similar.

As used herein, a heterologous nucleic acid (also referred to as exogenous nucleic acid or foreign nucleic acid) refers to a nucleic acid that is not normally produced in vivo by an organism or virus from which it is expressed or that is produced by an organism or a virus but is at a different locus, or that mediates or encodes mediators that alter expression of endogenous nucleic acid, such as DNA, by affecting transcription, translation, or other regulatable biochemical processes. Hence, heterologous nucleic acid is often not normally endogenous to a virus into which it is introduced. Heterologous nucleic acid can refer to a nucleic acid molecule from another virus in the same organism or another organism, including the same species or another species. Heterologous nucleic acid, however, can be endogenous, but is nucleic acid that is expressed from a different locus or altered in its expression or sequence (e.g., a plasmid). Thus, heterologous nucleic acid includes a nucleic acid molecule not present in the exact orientation or position as the counterpart nucleic acid molecule, such as DNA, is found in a genome. Generally, although not necessarily, such nucleic acid encodes RNA and proteins that are not normally produced by the virus or in the same way in the virus in which it is expressed. Any nucleic acid, such as DNA, that one of skill in the art recognizes or considers as heterologous, exogenous or foreign to the virus in which the nucleic acid is expressed is herein encompassed by heterologous nucleic acid. Examples of heterologous nucleic acid include, but are not limited to, nucleic acid that encodes exogenous peptides/proteins, including diagnostic and/or therapeutic agents. Proteins that are encoded by heterologous nucleic acid can be expressed within the virus, secreted, or expressed on the surface of the virus in which the heterologous nucleic acid has been introduced.

As used herein, a viral clonal strain or virus strain preparation that contains heterologous nucleic acid refers to such strains that contain nucleic acid not present in the parental clonal strain. For example, the virus whose sequence is set forth in SEQ ID NO: 10 is a clonal strain, but the virus of SEQ ID NO: 9, designated GLV-1h68, contains heterologous nucleic acid, such as the insert designated RUC-GFP.

As used herein, a heterologous protein or heterologous polypeptide (also referred to as exogenous protein, exogenous polypeptide, foreign protein or foreign polypeptide) refers to a protein that is not normally produced by a virus.

As used herein, operative linkage of heterologous nucleic acids to regulatory and effector sequences of nucleotides, such as promoters, enhancers, transcriptional and translational stop sites, and other signal sequences refers to the relationship between such nucleic acid, such as DNA, and such sequences of nucleotides. For example, operative linkage of heterologous DNA to a promoter refers to the physical relationship between the DNA and the promoter such that the transcription of such DNA is initiated from the promoter by an RNA polymerase that specifically recognizes, binds to and transcribes the DNA. Thus, operatively linked or operationally associated refers to the functional relationship of a nucleic acid, such as DNA, with regulatory and effector sequences of nucleotides, such as promoters, enhancers, transcriptional and translational stop sites, and other signal sequences. For example, operative linkage of DNA to a promoter refers to the physical and functional relationship between the DNA and the promoter such that the transcription of such DNA is initiated from the promoter by an RNA polymerase that specifically recognizes, binds to and transcribes the DNA. In order to optimize expression and/or transcription, it can be necessary to remove, add or alter 5' untranslated portions of the clones to eliminate extra, potentially inappropriate, alternative translation initiation (i.e., start) codons or other sequences that can interfere with or reduce expression, either at the level of transcription or translation. In addition, consensus ribosome binding sites can be inserted immediately 5' of the start codon and can enhance expression (see, e.g., Kozak *J. Biol. Chem.* 266: 19867-19870 (1991) and Shine and Delgamo, *Nature* 254 (5495):34-38 (1975)). The desirability of (or need for) such modification can be empirically determined.

As used herein, a heterologous promoter refers to a promoter that is not normally found in the wild-type organism or virus or that is at a different locus as compared to a wild-type organism or virus. A heterologous promoter is often not endogenous to a virus into which it is introduced, but has been obtained from another virus or prepared synthetically. A heterologous promoter can refer to a promoter from another virus in the same organism or another organism, including the same species or another species. A heterologous promoter, however, can be endogenous, but is a promoter that is altered in its sequence or occurs at a different locus (e.g., at a different location in the genome or on a plasmid). Thus, a heterologous promoter includes a promoter not present in the exact orientation or position as the counterpart promoter is found in a genome.

A synthetic promoter is a heterologous promoter that has a nucleotide sequence that is not found in nature. A synthetic promoter can be a nucleic acid molecule that has a synthetic sequence or a sequence derived from a native promoter or portion thereof. A synthetic promoter can also be a hybrid promoter composed of different elements derived from different native promoters.

As used herein, dosing regime refers to the amount of agent, for example, a virus or other agent, administered, and the frequency of administration over the course of a cycle of administration. The dosing regime is a function of the disease or condition to be treated, and thus can vary.

As used herein, frequency of administration refers to the number of times an agent is administered during the cycle of administration. For example, frequency can be days, weeks or months. For example, frequency can be administration once during a cycle of administration, two times, three times, four times, five times, six times or seven times. The frequency can refer to consecutive days during the cycle of administration. The particular frequency is a function of the particular disease or condition treated.

As used herein, a "cycle of administration" refers to the repeated schedule of the dosing regime of administration of a virus that is repeated over successive administrations. For example, an exemplary cycle of administration is a 28 day cycle.

As used herein, treatment of a subject that has a condition, disorder or disease means any manner of treatment in which the symptoms of the condition, disorder or disease are ameliorated or otherwise beneficially altered. Treatment encompasses any pharmaceutical use of the viruses described and provided herein.

As used herein, a disease or disorder refers to a pathological condition in an organism resulting from, for example, infection or genetic defect, and characterized by identifiable symptoms. An exemplary disease as described herein is a neoplastic disease, such as cancer.

As used herein, neoplastic disease refers to any disorder involving cancer, including tumor development, growth, metastasis and progression.

As used herein, cancer is a term for diseases caused by or characterized by any type of malignant tumor, including metastatic cancers, lymphatic tumors, and blood cancers. Exemplary cancers include, but are not limited to, leukemia, lymphoma, pancreatic cancer, lung cancer, ovarian cancer, breast cancer, cervical cancer, bladder cancer, prostate cancer, glioma tumors, adenocarcinomas, liver cancer and skin cancer. Exemplary cancers in humans include a bladder tumor, breast tumor, prostate tumor, basal cell carcinoma, biliary tract cancer, bladder cancer, bone cancer, brain and CNS cancer (e.g., glioma tumor), cervical cancer, choriocarcinoma, colon and rectum cancer, connective tissue cancer, cancer of the digestive system; endometrial cancer, esophageal cancer; eye cancer; cancer of the head and neck; gastric cancer; intra-epithelial neoplasm; kidney cancer; larynx cancer; leukemia; liver cancer; lung cancer (e.g., small cell and non-small cell); lymphoma including Hodgkin's and Non-Hodgkin's lymphoma; melanoma; myeloma, neuroblastoma, oral cavity cancer (e.g., lip, tongue, mouth, and pharynx); ovarian cancer; pancreatic cancer, retinoblastoma; rhabdomyosarcoma; rectal cancer, renal cancer, cancer of the respiratory system; sarcoma, skin cancer; stomach cancer, testicular cancer, thyroid cancer; uterine cancer, cancer of the urinary system, as well as other carcinomas and sarcomas. Exemplary cancers commonly diagnosed in dogs, cats, and other pets include, but are not limited to, lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma (e.g., granulocytic sarcoma), corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma and cystadenoma, follicular lymphoma, intestinal lymphosarcoma, fibrosarcoma and pulmonary squamous cell carcinoma. Exemplary cancers diagnosed in rodents, such as a ferret, include, but are not limited to, insulinoma, lymphoma, sarcoma, neuroma, pancreatic islet cell tumor, gastric MALT lymphoma and gastric adenocarcinoma. Exemplary neoplasias affecting agricultural livestock include, but are not limited to, leukemia, hemangiopericytoma and bovine ocular neoplasia (in cattle); preputial fibrosarcoma, ulcerative squamous cell carcinoma, preputial carcinoma, connective tissue neoplasia and mastocytoma (in horses); hepatocellular carcinoma (in swine); lymphoma and pulmonary adenomatosis (in sheep); pulmonary sarcoma, lymphoma, Rous sarcoma, reticuloendotheliosis, fibrosarcoma, nephroblastoma, B-cell lymphoma and lymphoid leukosis (in avian species); retinoblastoma, hepatic neoplasia, lymphosarcoma (lymphoblastic lymphoma), plasmacytoid leukemia and swimbladder sarcoma (in fish), caseous lymphadenitis (CLA): chronic, infectious, contagious disease of sheep and goats caused by the bacterium *Corynebacterium pseudotuberculosis*, and contagious lung tumor of sheep caused by jaagsiekte.

As used herein, a "metastasis" refers to the spread of cancer from one part of the body to another. For example, in the metastatic process, malignant cells can spread from the site of the primary tumor in which the malignant cells arose and move into lymphatic and blood vessels, which transport the cells to normal tissues elsewhere in an organism where the cells continue to proliferate. A tumor formed by cells that have spread by metastasis is called a "metastatic tumor," a "secondary tumor" or a "metastasis."

As used herein, treatment of a subject that has a neoplastic disease, including a tumor or metastasis, means any manner of treatment in which the symptoms of having the neoplastic disease are ameliorated or otherwise beneficially altered.

Typically, treatment of a tumor or metastasis in a subject encompasses any manner of treatment that results in slowing of tumor growth, lysis of tumor cells, reduction in the size of the tumor, prevention of new tumor growth, or prevention of metastasis of a primary tumor, including inhibition vascularization of the tumor, tumor cell division, tumor cell migration or degradation of the basement membrane or extracellular matrix.

As used herein, amelioration or alleviation of the symptoms of a particular disorder, such as by administration of a particular pharmaceutical composition, refers to any lessening, whether permanent or temporary, lasting or transient that can be attributed to or associated with administration of the composition.

As used herein, an effective amount, or therapeutically effective amount, of a virus or compound for treating a particular disease is an amount to ameliorate, or in some manner reduce the symptoms associated with the disease. The amount will vary from one individual to another and will depend upon a number of factors, including, but not limited to, age, weight, the overall physical condition of the patient and the severity of the disease. A therapeutically effective amount can be administered as a single dosage or can be administered in multiple dosages according to a regimen, whereby it is effective. The amount can cure the disease but, typically, is administered in order to ameliorate the symptoms of the disease. Repeated administration can be required to achieve the desired amelioration of symptoms.

As used herein, an effective amount, or therapeutically effective amount, of a virus or compound for treating a neoplastic disease, including a tumor or metastasis is an amount to ameliorate, or in some manner reduce the symptoms associated with the neoplastic disease, including, but not limited to slowing of tumor growth, lysis of tumor cells, reduction in the size of the tumor, prevention of new tumor growth, or prevention of metastasis of a primary tumor.

As used herein, a "therapeutic index" with respect to the treatment of a tumor refers to the ability of a treatment, including treatment with a virus provided herein or a combination therapy with a virus provided herein, to cause slowing of tumor growth and/or the reduction in the volume of a tumor. Typically, the therapeutic index is expressed as a ratio with respect to a control treatment, such as no treatment with the virus. The higher the therapeutic index, the more effective the treatment is at slowing tumor growth and/or reducing the volume of the tumor.

As used herein, "delayed replication" refers to the inability of a therapeutic virus to efficiently replicate in a tumor. Therapeutic viruses that exhibit delayed replication can have the ability to replicate in the cells of the tumor, but do so at a slower replication rate. Viruses that exhibit delayed replication in a tumor following infection of the tumor are not as effective for therapy of the tumor as viruses that do not exhibit delayed replication.

As used herein, the term "therapeutic virus" refers to a virus that is administered for the treatment of a disease or disorder, such as a neoplastic disease, such as cancer, a tumor and/or a metastasis or inflammation or wound or diagnosis thereof and or both. Generally, a therapeutic virus herein is one that exhibits anti-tumor activity and minimal toxicity.

As used herein, a tumor, also known as a neoplasm, is an abnormal mass of tissue that results when cells proliferate at an abnormally high rate. Tumors may show partial or total lack of structural organization and functional coordination with normal tissue. Tumors can be benign (not cancerous), or malignant (cancerous). As used herein, a tumor is intended to encompass hematopoietic tumors as well as solid tumors.

Malignant tumors can be broadly classified into three major types. Carcinomas are malignant tumors arising from epithelial structures (e.g. breast, prostate, lung, colon, pancreas). Sarcomas are malignant tumors that originate from connective tissues, or mesenchymal cells, such as muscle, cartilage, fat or bone. Leukemias and lymphomas are malignant tumors affecting hematopoietic structures (structures pertaining to the formation of blood cells) including components of the immune system. Other malignant tumors include, but are not limited to, tumors of the nervous system (e.g. neurofibromatomas), germ cell tumors, and blastic tumors.

As used herein, proliferative disorders include any disorders involving abnormal proliferation of cells (i.e. cells proliferate more rapidly compared to normal tissue growth), such as, but not limited to, neoplastic diseases.

As used herein, a "tumor cell" is any cell that is part of a tumor. Typically, the viruses provided herein preferentially infect tumor cells in a subject compared to normal cells.

As used herein, a "metastatic cell" is a cell that has the potential for metastasis. Metastatic cells have the ability to metastasize from a first tumor in a subject and can colonize tissue at a different site in the subject to form a second tumor at the site.

As used herein, "tumorigenic cell," is a cell that, when introduced into a suitable site in a subject, can form a tumor. The cell can be non-metastatic or metastatic.

As used herein, a "normal cell" is a cell that is not derived from a tumor.

As used herein, the term "cell" refers to the basic unit of structure and function of a living organism as is commonly understood in the biological sciences. A cell can be a unicellular organism that is self-sufficient and that can exist as a functional whole independently of other cells. A cell can also be one that, when not isolated from the environment in which it occurs in nature, is part of a multicellular organism made up of more than one type of cell. Such a cell, which can be thought of as a "non-organism" or "non-organismal" cell, generally is specialized in that it performs only a subset of the functions performed by the multicellular organism as whole. Thus, this type of cell is not a unicellular organism. Such a cell can be a prokaryotic or eukaryotic cell, including animal cells, such as mammalian cells, human cells and non-human animal cells or non-human mammalian cells. Animal cells include any cell of animal origin that can be found in an animal. Thus, animal cells include, for example, cells that make up the various organs, tissues and systems of an animal.

As used herein an "isolated cell" is a cell that exists in vitro and is separate from the organism from which it was originally derived.

As used herein, a "cell line" is a population of cells derived from a primary cell that is capable of stable growth in vitro for many generations. Cell lines are commonly referred to as "immortalized" cell lines to describe their ability to continuously propagate in vitro.

As used herein a "tumor cell line" is a population of cells that is initially derived from a tumor. Such cells typically have undergone some change in vivo such that they theoretically have indefinite growth in culture; unlike primary cells, which can be cultured only for a finite period of time. Moreover, such cells preferably can form tumors after they are injected into susceptible animals.

As used herein, a "primary cell" is a cell that has been isolated from a subject.

As used herein, a "host cell" or "target cell" are used interchangeably to mean a cell that can be infected by a virus.

As used herein, the term "tissue" refers to a group, collection or aggregate of similar cells generally acting to perform a specific function within an organism.

As used herein, the terms immunoprivileged cells and immunoprivileged tissues refer to cells and tissues, such as solid tumors, which are sequestered from the immune system. Generally, administration of a virus to a subject elicits an immune response that clears the virus from the subject. Immunoprivileged sites, however, are shielded or sequestered from the immune response, permitting the virus to survive and generally to replicate. Immunoprivileged tissues include proliferating tissues, such as tumor tissues.

As used herein, therapeutic agents are agents that ameliorate the symptoms of a disease or disorder or ameliorate the disease or disorder. Therapeutic agent, therapeutic compound, or therapeutic regimens include conventional drugs and drug therapies, including vaccines for treatment or prevention (i.e., reducing the risk of getting a particular disease or disorder), which are known to those skilled in the art and described elsewhere herein. Therapeutic agents for the treatment of neoplastic disease include, but are not limited to, moieties that inhibit cell growth or promote cell death, that can be activated to inhibit cell growth or promote cell death, or that activate another agent to inhibit cell growth or promote cell death. Therapeutic agents for use in the methods provided herein can be, for example, an anticancer agent. Exemplary therapeutic agents include, for example, therapeutic microorganisms, such as therapeutic viruses and bacteria, cytokines, growth factors, photosensitizing agents, radionuclides, toxins, antimetabolites, signaling modulators, anticancer antibiotics, anticancer antibodies, angiogenesis inhibitors, radiation therapy, chemotherapeutic compounds or a combination thereof.

As used herein, an anticancer agent or compound (used interchangeably with "antitumor or antineoplastic agent") refers to any agents, or compounds, used in anticancer treatment. These include any agents, when used alone or in combination with other compounds or treatments, that can alleviate, reduce, ameliorate, prevent, or place or maintain in a state of remission of clinical symptoms or diagnostic markers associated with neoplastic disease, tumors and cancer, and can be used in methods, combinations and compositions provided herein. Anticancer agents include antimetastatic agents. Exemplary anticancer agents include, but are not limited to, chemotherapeutic compounds (e.g., toxins, alkylating agents, nitrosoureas, anticancer antibiotics, antimetabolites, antimitotics, topoisomerase inhibitors), cytokines, growth factors, hormones, photosensitizing agents, radionuclides, signaling modulators, anticancer antibodies, anticancer oligopeptides, anticancer oligonucleotides (e.g., antisense RNA and siRNA), angiogenesis inhibitors, radiation therapy, or a combination thereof. Exemplary chemotherapeutic compounds include, but are not limited to, Ara-C, cisplatin, carboplatin, paclitaxel, doxorubicin, gemcitabine, camptothecin, irinotecan, cyclophosphamide, 6-mercaptopurine, vincristine, 5-fluorouracil, and methotrexate. As used herein, reference to an anticancer or chemotherapeutic agent includes combinations or a plurality of anticancer or chemotherapeutic agents unless otherwise indicated.

As used herein, a "chemosensitizing agent" is an agent which modulates, attenuates, reverses, or affects a cell's or organism's resistance to a given chemotherapeutic drug or compound. The terms "modulator", "modulating agent", "attenuator", "attenuating agent", or "chemosensitizer" can be used interchangeably to mean "chemosensitizing agent." In some examples, a chemosensitizing agent can also be a chemotherapeutic agent. Examples of chemosensitizing agents include, but are not limited to, radiation, calcium channel blockers (e.g., verapamil), calmodulin inhibitors (e.g., trifluoperazine), indole alkaloids (e.g., reserpine), quinolines (e.g., quinine), lysosomotropic agents (e.g., chloroquine), steroids (e.g., progesterone), triparanol analogs (e.g., tamoxifen), detergents (e.g., Cremophor® EL), texaphyrins, and cyclic antibiotics (e.g., cyclosporine).

As used herein, a compound produced in a tumor or other immunoprivileged site refers to any compound that is produced in the tumor or tumor environment by virtue of the presence of an introduced virus, generally a recombinant virus, expressing one or more gene products. For example, a compound produced in a tumor can be, for example, an encoded polypeptide or RNA, a metabolite, or compound that is generated by a recombinant polypeptide and the cellular machinery of the tumor or immunoprivileged tissue or cells.

As used herein, a subject includes any organism, including an animal for whom diagnosis, screening, monitoring or treatment is contemplated. Animals include mammals such as primates and domesticated animals. An exemplary primate is human. A patient refers to a subject, such as a mammal, primate, human, or livestock subject afflicted with a disease condition or for which a disease condition is to be determined or risk of a disease condition is to be determined.

As used herein, a delivery vehicle for administration refers to a lipid-based or other polymer-based composition, such as liposome, micelle or reverse micelle, that associates with an agent, such as a virus provided herein, for delivery into a host subject.

As used herein, vector (or plasmid) refers to a nucleic acid construct that contains discrete elements that are used to introduce heterologous nucleic acid into cells for either expression of the nucleic acid or replication thereof. The vectors typically remain episomal, but can be designed to effect stable integration of a gene or portion thereof into a chromosome of the genome. Selection and use of such vectors are well known to those of skill in the art. Expression vectors include vectors capable of expressing DNA that is operatively linked with regulatory sequences, such as promoter regions, that are capable of effecting expression of the DNA fragments. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, the term "viral vector" is used according to its art-recognized meaning. It refers to a nucleic acid vector that includes at least one element of viral origin and can be packaged into a viral vector particle. The viral vector particles can be used for the purpose of transferring DNA, RNA or other nucleic acids into cells either in vitro or in vivo. Viral vectors include, but are not limited to, poxvirus vectors (e.g., vaccinia vectors), retroviral vectors, lentivirus vectors, herpes virus vectors (e.g., HSV), baculovirus vectors, cytomegalovirus (CMV) vectors, papillomavirus vectors, simian virus (SV40) vectors, semliki forest virus vectors, phage vectors, adenoviral vectors and adeno-associated viral (AAV) vectors.

As used herein, nucleic acids include DNA, RNA and analogs thereof, including peptide nucleic acids (PNA) and mixtures thereof. Nucleic acids can be single or double-stranded. Nucleic acids can encode gene products, such as, for example, polypeptides, regulatory RNAs, microRNAs, siRNAs and functional RNAs.

As used herein, a sequence complementary to at least a portion of an RNA, with reference to antisense oligonucleotides, means a sequence of nucleotides having sufficient complementarity to be able to hybridize with the RNA, generally under moderate or high stringency conditions, forming a stable duplex; in the case of double-stranded antisense nucleic acids, a single strand of the duplex DNA (i.e., dsRNA) can thus be assayed, or triplex formation can be assayed. The ability to hybridize depends on the degree of complementarity and the length of the antisense nucleic acid. Generally, the longer the hybridizing nucleic acid, the more base mismatches with an encoding RNA it can contain and still form a stable duplex (or triplex, as the case can be). One skilled in the art can ascertain a tolerable degree of mismatch by use of standard procedures to determine the melting point of the hybridized complex.

As used herein, a detectable label or detectable moiety or diagnostic moiety (also imaging label, imaging agent, or imaging moiety) refers to an atom, molecule or composition, wherein the presence of the atom, molecule or composition can be directly or indirectly measured. Detectable labels can be used to image one or more of any of the viruses provided herein. Detectable labels can be used in any of the methods provided herein. Detectable labels include, for example, chemiluminescent moieties, bioluminescent moieties, fluorescent moieties, radionuclides, and metals. Methods for detecting labels are well known in the art. Such a label can be detected, for example, by visual inspection, by fluorescence spectroscopy, by reflectance measurement, by flow cytometry, by X-rays, by a variety of magnetic resonance methods such as magnetic resonance imaging (MRI) and magnetic resonance spectroscopy (MRS). Methods of detection also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography, and ultrasonic tomography. Direct detection of a detectable label refers to, for example, measurement of a physical phenomenon of the detectable label itself, such as energy or particle emission or absorption of the label itself, such as by X-ray or MRI. Indirect detection refers to measurement of a physical phenomenon of an atom, molecule or composition that binds directly or indirectly to the detectable label, such as energy or particle emission or absorption, of an atom, molecule or composition that binds directly or indirectly to the detectable label. In a non-limiting example of indirect detection, a detectable label can be biotin, which can be detected by binding to avidin. Non-labeled avidin can be administered systemically to block non-specific binding, followed by systemic administration of labeled avidin. Thus, included within the scope of a detectable label or detectable moiety is a bindable label or bindable moiety, which refers to an atom, molecule or composition, wherein the presence of the atom, molecule or composition can be detected as a result of the label or moiety binding to another atom, molecule or composition. Exemplary detectable labels include, for example, metals such as colloidal gold, iron, gadolinium, and gallium-67, fluorescent moieties, and radionuclides. Exemplary fluorescent moieties and radionuclides are provided elsewhere herein.

As used herein, a radionuclide, a radioisotope or radioactive isotope is used interchangeably to refer to an atom with an unstable nucleus. The nucleus is characterized by excess energy which is available to be imparted either to a newly-created radiation particle within the nucleus, or else to an atomic electron. The radionuclide, in this process, undergoes radioactive decay, and emits a gamma ray and/or subatomic particles. Such emissions can be detected in vivo by method such as, but not limited to, positron emission tomography (PET), single-photon emission computed tomography (SPECT) or planar gamma imaging. Radioisotopes can occur naturally, but can also be artificially produced. Exemplary radionuclides for use in in vivo imaging include, but are not limited to, $^{11}C$, $^{13}C$, $^{13}N$, $^{15}N$, $^{15}O$, $^{18}F$, $^{19}F$, $^{32}P$, $^{52}Fe$, $^{51}Cr$, $^{55}Co$, $^{55}Fe$, $^{57}Co$, $^{58}Co$, $^{52}Ni$, $^{59}Fe$, $^{60}Co$, $^{64}Cu$, $^{67}Ga$, $^{68}Ga$, $^{60}Cu(II)$, $^{67}Cu(II)$, $^{90}Y$, $^{99}Tc$, $^{103}Pd$, $^{106}Ru$, $^{111}In$, $^{117}Lu$, $^{123}I$, $^{124}I$, $^{125}I$, $^{131}I$, $^{137}Cs$, $^{153}Gd$, $^{153}Sm$, $^{186}Re$, $^{188}Re$, $^{192}Ir$, $^{198}Au$, $^{211}At$, $^{212}Bi$, $^{213}Bi$ and $^{241}Am$. Radioisotopes can be incorporated into or attached to a compound, such as a metabolic compound. Exemplary radionuclides that can be incorporated or linked to a metabolic compound, such as nucleoside analog, include, but are not limited to, $^{123}I$, $^{124}I$, $^{125}I$, $^{131}I$, $^{18}F$, $^{19}F$, $^{11}C$, $^{13}C$, $^{14}C$, $^{75}Br$, $^{76}Br$, and $^3H$. Exemplary radiolabeled compounds include nucleoside analogs, such as, but not limited to, radiolabeled forms of 1-(2'-deoxy-2'-fluoro-β-D-arabinofuranosyl)-5-iodouracil (FIAU), 1-(2'-deoxy-2'-fluoro-β-D-arabinofuranosyl)-5-ethyluracil (FEAU), 1-(2'-deoxy-2'-fluoro-β-D-arabinofuranosyl)-5-methyluracil (FMAU), 3'-deoxy-3'-fluorothymidine (FLT), 9-[4'-fluoro-3'-(hydroxymethyl)butyl]guanine (FHBG) and 9-[(3'-fluoro-1'-hydroxy-2'-propoxy)methyl]guanine (FHPG), such as, for example, $[^{125}I]$-1-(2'-deoxy-2'-fluoro-β-D-arabinofuranosyl)-5-iodouracil ($[^{125}I]$-FIAU), $[^{124}I]$-1-(2'-deoxy-2'-fluoro-β-D-arabinofuranosyl)-5-iodouracil ($[^{124}I]$-FIAU), $[^{18}F]$-1-(2'-deoxy-2'-fluoro-β-D-arabinofuranosyl)-5-iodouracil ($[^{18}F]$-FIAU), $[^{18}F]$-1-(2'-deoxy-2'-fluoro-β-D-arabinofuranosyl)-5-ethyluracil ($[^{18}F]$-FEAU), $[^{18}F]$-1-(2'-deoxy-2'-fluoro-β-D-arabinofuranosyl)-5-methyluracil ($[^{18}F]$-FMAU), $[^{18}F]$-3'-deoxy-3'-fluorothymidine ($[^{18}F]$-FLT), $[^{18}F]$-9-[4'-fluoro-3'-(hydroxymethyl)butyl]guanine ($[^{18}F]$-FHBG) and 9-[(3'-fluoro-1'-hydroxy-2'-propoxy)methyl]guanine ($[^{18}F]$-FHPG).

As used herein, magnetic resonance imaging (MRI) refers to the use of a nuclear magnetic resonance spectrometer to produce electronic images of specific atoms and molecular structures in solids, especially human cells, tissues, and organs. MRI is non-invasive diagnostic technique that uses nuclear magnetic resonance to produce cross-sectional images of organs and other internal body structures. The subject lies inside a large, hollow cylinder containing a strong electromagnet, which causes the nuclei of certain atoms in the body (such as, for example, $^1H$, $^{13}C$ and $^{19}F$) to align magnetically. The subject is then subjected to radio waves, which cause the aligned nuclei to flip; when the radio waves are withdrawn the nuclei return to their original positions, emitting radio waves that are then detected by a receiver and translated into a two-dimensional picture by computer. For some MRI procedures, contrast agents such as gadolinium are used to increase the accuracy of the images.

As used herein, an X-ray refers to a relatively high-energy photon, or a stream of such photons, having a wavelength in the approximate range from 0.01 to 10 nanometers. X-rays also refer to photographs taken with x-rays.

As used herein, a compound conjugated to a moiety refers to a complex that includes a compound bound to a moiety, where the binding between the compound and the moiety can arise from one or more covalent bonds or non-covalent interactions such as hydrogen bonds, or electrostatic interactions. A conjugate also can include a linker that connects the compound to the moiety. Exemplary compounds include, but are not limited to, nanoparticles and siderophores. Exemplary moieties, include, but are not limited to, detectable moieties and therapeutic agents.

As used herein, luminescence refers to the detectable electromagnetic (EM) radiation, generally, ultraviolet (UV), infrared (IR) or visible EM radiation that is produced when the excited product of an exergonic chemical process reverts to its ground state with the emission of light. Chemiluminescence is luminescence that results from a chemical reaction. Bioluminescence is chemiluminescence that results from a chemical reaction using biological molecules (or synthetic versions or analogs thereof) as substrates and/or enzymes. Fluorescence is luminescence in which light of a visible color is emitted from a substance under stimulation or excitation by light or other forms radiation such as ultraviolet (UV), infrared (IR) or visible EM radiation.

As used herein, chemiluminescence refers to a chemical reaction in which energy is specifically channeled to a molecule causing it to become electronically excited and subsequently to release a photon, thereby emitting visible light. Temperature does not contribute to this channeled energy. Thus, chemiluminescence involves the direct conversion of chemical energy to light energy.

As used herein, bioluminescence, which is a type of chemiluminescence, refers to the emission of light by biological molecules, particularly proteins. The essential condition for bioluminescence is molecular oxygen, either bound or free in the presence of an oxygenase, a luciferase, which acts on a substrate, a luciferin. Bioluminescence is generated by an enzyme or other protein (luciferase) that is an oxygenase that acts on a substrate luciferin (a bioluminescence substrate) in the presence of molecular oxygen and transforms the substrate to an excited state, which, upon return to a lower energy level releases the energy in the form of light.

As used herein, the substrates and enzymes for producing bioluminescence are generically referred to as luciferin and luciferase, respectively. When reference is made to a particular species thereof, for clarity, each generic term is used with the name of the organism from which it derives such as, for example, click beetle luciferase or firefly luciferase.

As used herein, luciferase refers to oxygenases that catalyze a light emitting reaction. For instance, bacterial luciferases catalyze the oxidation of flavin mononucleotide (FMN) and aliphatic aldehydes, which reaction produces light. Another class of luciferases, found among marine arthropods, catalyzes the oxidation of Cypridina (Vargula) luciferin and another class of luciferases catalyzes the oxidation of Coleoptera luciferin. Thus, luciferase refers to an enzyme or photoprotein that catalyzes a bioluminescent reaction (a reaction that produces bioluminescence). The luciferases, such as firefly and Gaussia and *Renilla* luciferases, are enzymes which act catalytically and are unchanged during the bioluminescence generating reaction. The luciferase photoproteins, such as the aequorin photoprotein to which luciferin is non-covalently bound, are changed, such as by release of the luciferin, during bioluminescence generating reaction. The luciferase is a protein, or a mixture of proteins (e.g., bacterial luciferase), that occurs naturally in an organism or a variant or mutant thereof, such as a variant produced by mutagenesis that has one or more properties, such as thermal stability, that differ from the naturally-occurring protein. Luciferases and modified mutant or variant forms thereof are well known. For purposes herein, reference to luciferase refers to either the photoproteins or luciferases.

Reference, for example, to *Renilla* luciferase refers to an enzyme isolated from member of the genus *Renilla* or an equivalent molecule obtained from any other source, such as from another related copepod, or that has been prepared synthetically. It is intended to encompass *Renilla* luciferases with conservative amino acid substitutions that do not substantially alter activity. Conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224).

As used herein, bioluminescence substrate refers to the compound that is oxidized in the presence of a luciferase and any necessary activators and generates light. These substrates are referred to as luciferins herein, are substrates that undergo oxidation in a bioluminescence reaction. These bioluminescence substrates include any luciferin or analog thereof or any synthetic compound with which a luciferase interacts to generate light. Typical substrates include those that are oxidized in the presence of a luciferase or protein in a light-generating reaction. Bioluminescence substrates, thus, include those compounds that those of skill in the art recognize as luciferins. Luciferins, for example, include firefly luciferin, Cypridina (also known as Vargula) luciferin (coelenterazine), bacterial luciferin, as well as synthetic analogs of these substrates or other compounds that are oxidized in the presence of a luciferase in a reaction the produces bioluminescence.

As used herein, capable of conversion into a bioluminescence substrate refers to being susceptible to chemical reaction, such as oxidation or reduction, which yields a bioluminescence substrate. For example, the luminescence producing reaction of bioluminescent bacteria involves the reduction of a flavin mononucleotide group (FMN) to reduced flavin mononucleotide ($FMNH_2$) by a flavin reductase enzyme. The reduced flavin mononucleotide (substrate) then reacts with oxygen (an activator) and bacterial luciferase to form an intermediate peroxy flavin that undergoes further reaction, in the presence of a long-chain aldehyde, to generate light. With respect to this reaction, the reduced flavin and the long chain aldehyde are bioluminescence substrates.

As used herein, a bioluminescence generating system refers to the set of reagents required to conduct a bioluminescent reaction. Thus, the specific luciferase, luciferin and other substrates, solvents and other reagents that can be required to complete a bioluminescent reaction form a bioluminescence system. Thus a bioluminescence generating system refers to any set of reagents that, under appropriate reaction conditions, yield bioluminescence. Appropriate reaction conditions refer to the conditions necessary for a bioluminescence reaction to occur, such as pH, salt concentrations and temperature. In general, bioluminescence systems include a bioluminescence substrate, luciferin, a luciferase, which includes enzymes luciferases and photoproteins and one or more activators. A specific bioluminescence system can be identified by reference to the specific organism from which the luciferase derives; for example, the *Renilla* bioluminescence system includes a *Renilla* luciferase, such as a luciferase isolated from *Renilla* or produced using recombinant methods or modifications of these luciferases. This system also includes the particular activators necessary to complete the bioluminescence reaction, such as oxygen and a substrate with which the luciferase reacts in the presence of the oxygen to produce light.

As used herein, a fluorescent protein (FP) refers to a protein that possesses the ability to fluoresce (i.e., to absorb energy at one wavelength and emit it at another wavelength). For example, a green fluorescent protein (GFP) refers to a polypeptide that has a peak in the emission spectrum at 510 nm or about 510 nm. A variety of FPs that emit at various wavelengths are known in the art. Exemplary FPs include, but are not limited to, a green fluorescent protein (GFP), yellow fluorescent protein (YFP), orange fluorescent protein (OFP), cyan fluorescent protein (CFP), blue fluorescent protein (BFP), red fluorescent protein (RFP), far-red fluorescent protein, or near-infrared fluorescent protein. Extending the spectrum of available colors of fluorescent proteins to blue, cyan, orange, yellow and red variants provides a method for multicolor tracking of fusion proteins.

As used herein, *Aequorea* GFP refers to GFPs from the genus *Aequorea* and to mutants or variants thereof. Such variants and GFPs from other species, such as *Anthozoa* reef coral, *Anemonia* sea anemone, *Renilla* sea pansy, *Galaxea* coral, *Acropora* brown coral, *Trachyphyllia* and *Pectiniidae* stony coral and other species are well known and are available and known to those of skill in the art. Exemplary GFP variants include, but are not limited to BFP, CFP, YFP and OFP. Examples of florescent proteins and their variants include GFP proteins, such as Emerald (Invitrogen, Carlsbad, Calif.), EGFP (Clontech, Palo Alto, Calif.), CoralHue® Azami-Green (MBL International, Woburn, Mass.), CoralHue® Kaede (MBL International, Woburn, Mass.), BD Living Colors™ ZsGreen1 (Clontech, Palo Alto, Calif.) and CopGFP (Evrogen/Axxora, LLC, San Diego, Calif.); CFP proteins, such as Cerulean (Rizzo, *Nat Biotechnol.* 22(4): 445-9 (2004)), mCFP (Wang et al., *PNAS U.S.A.* 101(48): 16745-9 (2004)), BD Living Colors™ AmCyan1 (Clontech, Palo Alto, Calif.), CoralHue® MiCy (MBL International, Woburn, Mass.), and CyPet (Nguyen and Daugherty, *Nat Biotechnol.* 23(3):355-60 (2005)); BFP proteins such as EBFP (Clontech, Palo Alto, Calif.); YFP proteins such as EYFP (Clontech, Palo Alto, Calif.), YPet (Nguyen and Daugherty, *Nat Biotechnol.* 23(3):355-60 (2005)), Venus (Nagai et al., *Nat. Biotechnol.* 20(1):87-90 (2002)), BD Living Colors™ ZsYellow (Clontech, Palo Alto, Calif.), and mCitrine (Wang et al., *Proc. Natl. Acad. Sci. U.S.A.* 101 (48):16745-9 (2004)); OFP proteins such as cOFP (Stratagene, La Jolla, Calif.), CoralHue® mKO (MBL International, Woburn, Mass.), and mOrange; and others (see, e.g., Shaner N C, Steinbach P A, and Tsien R Y., *Nat Methods.* 2(12):905-9 (2005)).

As used herein, red fluorescent protein, or RFP, refers to the *Discosoma* RFP (DsRed) that has been isolated from the corallimorph *Discosoma* (Matz et al., *Nature Biotechnology* 17: 969-973 (1999)), and red or far-red fluorescent proteins from any other species, such as *Heteractis* reef coral and *Actinia* or *Entacmaea* sea anemone, as well as variants thereof. RFPs include, for example, *Discosoma* variants, such as monomeric red fluorscent protein 1 (mRFP1), mCherry, tdTomato, mStrawberry, mTangerine (Wang et al., PNAS USA. 101(48):16745-9 (2004)), BD Living Colors™ DsRed2 (Clontech, Palo Alto, Calif.), and DsRed-T1 (Bevis and Glick, Nat. Biotechnol., 20: 83-87 (2002)), Anthomedusa J-Red (Evrogen) and BD Living Colors™ Anemonia AsRed2 (Clontech, Palo Alto, Calif.). Far-red fluorescent proteins include, for example, Actinia AQ143 (Shkrob et al., Biochem J. 392(Pt 3):649-54 (2005)), Entacmaea eqFP611 (Wiedenmann et al. Proc. Natl. Acad. Sci. USA. 99(18): 11646-51 (2002)), Discosoma variants such as mPlum and mRasberry (Wang et al., PNAS USA. 101(48):16745-9 (2004)), and BD Living Colors™ Heteractis HcRed1 and t-HcRed (Clontech, Palo Alto, Calif.).

As used herein, red fluorescent protein, or RFP, refers to the Discosoma RFP (DsRed) that has been isolated from the corallimorph Discosoma (Matz et al., Nature Biotechnology 17: 969-973 (1999)), and red or far-red fluorescent proteins from any other species, such as Heteractis reef coral and Actinia or Entacmaea sea anemone, as well as variants thereof. RFPs include, for example, Discosoma variants, such as monomeric red fluorescent protein 1 (mRFPI), mCherry, tdTomato, mStrawberry, mTangerine (Wang et al., PNAS USA. 101(48):16745-9 (2004)), DsRed2 (Clontech, Palo Alto, Calif.), and DsRed-T 1 (Bevis and Glick, Nat. Biotechnol., 20: 83-87 (2002)), Anthomedusa J-Red (Evrogen) and Anemonia AsRed2 (Clontech, Palo Alto, Calif.). Far-red fluorescent proteins include, for example, Actinia AQ143 (Shkrob et al., Biochem J. 392(Pt 3):649-54 (2005)), Entacmaea eqFP611 (Wiedenmann et al. Proc. Natl. Acad. Sci. USA. 99(18):11646-51 (2002)), Discosoma variants such as mPlum and mRasberry (Wang et al., PNAS USA. 101(48):16745-9 (2004)), and Heteractis HcRed1 and t-HcRed (Clontech, Palo Alto, Calif.).

As used herein, an in vivo method refers to a method performed within the living body of a subject.

As used herein, genetic therapy or gene therapy involves the transfer of heterologous nucleic acid, such as DNA or RNA, into certain cells, target cells, of a mammal, particularly a human, with a disorder or conditions for which such therapy is sought. As used herein, genetic therapy or gene therapy can involve the transfer of heterologous nucleic acid, such as DNA, into a microorganism (e.g., a virus), which microorganism can be transferred to a mammal, particularly a human, with a disorder or conditions for which such therapy is sought. The nucleic acid, such as DNA, is introduced into the selected target cells, such as directly or indirectly, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA (e.g., RNAi, including siRNA) that is in some manner a therapeutic product, or which mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, the terms overproduce or overexpress when used in reference to a substance, molecule, compound or composition made in a cell refers to production or expression at a level that is greater than a baseline, normal or usual level of production or expression of the substance, molecule, compound or composition by the cell. A baseline, normal or usual level of production or expression includes no production/expression or limited, restricted or regulated production/expression. Such overproduction or overexpression is typically achieved by modification of cell.

As used herein, an agent or compound that modulates the activity of a protein or expression of a gene or nucleic acid either decreases or increases or otherwise alters the activity of the protein or, in some manner, up- or down-regulates or otherwise alters expression of the nucleic acid in a cell.

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH, refers to the free amino group present at the amino terminus of a polypeptide. COOH refers to the free carboxy group present at the carboxyl terminus of a polypeptide. In keeping with standard polypeptide nomenclature described in J. Biol. Chem. 243:3557-3559 (1968), and adopted 37 C.F.R. §§ 1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |

TABLE 1-continued

Table of Correspondence

| SYMBOL | | |
|---|---|---|
| 1-Letter | 3-Letter | AMINO ACID |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§ 1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH, or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, recitation that nucleotides or amino acids "correspond to" nucleotides or amino acids in a disclosed sequence, such as set forth in the Sequence listing, refers to nucleotides or amino acids identified upon alignment with the disclosed sequence to maximize identity using a standard alignment algorithm, such as the GAP algorithm. By aligning the sequences, one skilled in the art can identify corresponding residues, for example, using conserved and identical amino acid residues as guides. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; Computer Analysis of Sequence Data, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As used herein, "sequence identity" refers to the number of identical or similar amino acids or nucleotide bases in a comparison between a test and a reference poly-peptide or polynucleotide. Sequence identity can be determined by sequence alignment of nucleic acid or protein sequences to identify regions of similarity or identity. For purposes herein, sequence identity is generally determined by alignment to identify identical residues. The alignment can be local or global. Matches, mismatches and gaps can be identified between compared sequences. Gaps are null amino acids or nucleotides inserted between the residues of aligned sequences so that identical or similar characters are aligned. Generally, there can be internal and terminal gaps. Sequence identity can be determined by taking into account gaps as the number of identical residues/length of the shortest sequence×100. When using gap penalties, sequence identity can be determined with no penalty for end gaps (e.g. terminal gaps are not penalized). Alternatively, sequence identity can be determined without taking into account gaps as the number of identical positions/length of the total aligned sequence×100.

As used herein, a "global alignment" is an alignment that aligns two sequences from beginning to end, aligning each letter in each sequence only once. An alignment is produced, regardless of whether or not there is similarity or identity between the sequences. For example, 50% sequence identity based on "global alignment" means that in an alignment of the full sequence of two compared sequences each of 100 nucleotides in length, 50% of the residues are the same. It is understood that global alignment also can be used in determining sequence identity even when the length of the aligned sequences is not the same. The differences in the terminal ends of the sequences will be taken into account in determining sequence identity, unless the "no penalty for end gaps" is selected. Generally, a global alignment is used on sequences that share significant similarity over most of their length. Exemplary algorithms for performing global alignment include the Needleman-Wunsch algorithm (Needleman et al. *J. Mol. Biol.* 48: 443 (1970). Exemplary programs for performing global alignment are publicly available and include the Global Sequence Alignment Tool available at the National Center for Biotechnology Information (NCBI) website (ncbi.nlm.nih.gov/), and the program available at deepc2.psi.iastate.edu/aat/align/align.html.

As used herein, a "local alignment" is an alignment that aligns two sequences, but only aligns those portions of the sequences that share similarity or identity. Hence, a local alignment determines if sub-segments of one sequence are present in another sequence. If there is no similarity, no alignment will be returned. Local alignment algorithms include BLAST or Smith-Waterman algorithm (*Adv. Appl. Math.* 2: 482 (1981)). For example, 50% sequence identity based on "local alignment" means that in an alignment of the full sequence of two compared sequences of any length, a region of similarity or identity of 100 nucleotides in length has 50% of the residues that are the same in the region of similarity or identity.

For purposes herein, sequence identity can be determined by standard alignment algorithm programs used with default gap penalties established by each supplier. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Whether any two nucleic acid molecules have nucleotide sequences (or any two polypeptides have amino acid sequences) that are at least 80%, 85%, 90%, 95%, 96%, 97%, 98% or 99% "identical," or other similar variations reciting a percent identity, can be determined using known computer algorithms based on local or global alignment (see e.g., wikipedia.org/wiki/Sequence_alignment_software, providing links to dozens of known and publicly available alignment databases and programs). Generally, for purposes herein sequence identity is determined using computer algorithms based on global alignment, such as the Needleman-Wunsch Global Sequence Alignment tool available from NCBI/BLAST (blast.ncbi.nlm.nih.gov/Blast.cgi?CMD=Web&Page_TYPE=BlastHome); LAlign (William Pearson implementing the Huang and Miller algorithm (*Adv. Appl. Math.* (1991) 12:337-357)); and program from Xiaoqui Huang available at deepc2.psi.iastate.edu/aat/align/align.html. Generally, when comparing nucleotide sequences herein, an alignment with no penalty for end gaps (e.g. terminal gaps are not penalized) is used.

Therefore, as used herein, the term "identity" represents a comparison or alignment between a test and a reference polypeptide or polynucleotide. In one non-limiting example, "at least 90% identical to" refers to percent identities from 90 to 100% relative to the reference polypeptide or polynucleotide. Identity at a level of 90% or more is indicative of the fact that, assuming for exemplification purposes a test and reference polypeptide or polynucleotide length of 100 amino acids or nucleotides are compared, no more than 10% (i.e., 10 out of 100) of amino acids or nucleotides in the test polypeptide or polynucleotide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. Depending on the length of the compared sequences, at the level of homologies or identities above about 85-90%, the result can be independent of the program and gap parameters set; such high levels of identity can be assessed readily, often without relying on software.

As used herein equivalent, when referring to two sequences of nucleic acids, means that the two sequences in question encode the same sequence of amino acids or equivalent proteins. When equivalent is used in referring to two proteins or peptides or other molecules, it means that the two proteins or peptides have substantially the same amino acid sequence with only amino acid substitutions (such as, but not limited to, conservative changes) or structure and that any changes do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially pure means sufficiently homogeneous to appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound can, however, be a mixture of stereoisomers or isomers. In such instances, further purification might increase the specific activity of the compound.

As used herein, the term assessing or determining is intended to include quantitative and qualitative determination in the sense of obtaining an absolute value for the activity of a product, and also of obtaining an index, ratio, percentage, visual or other value indicative of the level of the activity. Assessment can be direct or indirect.

As used herein, activity refers to the in vitro or in vivo activities of a compound or virus provided herein. For example, in vivo activities refer to physiological responses that result following in vivo administration thereof (or of a composition or other mixture). Activity, thus, encompasses resulting therapeutic effects and pharmaceutical activity of such compounds, compositions and mixtures. Activities can be observed in in vitro and/or in vivo systems designed to test or use such activities.

As used herein, a "composition" refers to any mixture of two or more products or compounds. It can be a solution, a suspension, liquid, powder, a paste, aqueous, non-aqueous, or any combination thereof.

As used herein, "a combination" refers to any association between two or among more items or elements. Exemplary combinations include, but are not limited to, two or more pharmaceutical compositions, a composition containing two or more active ingredients, such as two viruses, or a virus and an anticancer agent, such as a chemotherapeutic compound, two or more viruses, a virus and a therapeutic agent, a virus and an imaging agent, a virus and a plurality therapeutic and/or imaging agents, or any association thereof. Such combinations can be packaged as kits.

As used herein, a kit is a packaged combination, optionally, including instructions for use of the combination and/or other reactions and components for such use.

As used herein, a "control" or "standard" refers to a sample that is substantially identical to the test sample, except that it is not treated with a test parameter, or, if it is a plasma sample, it can be from a normal volunteer not affected with the condition of interest. A control also can be an internal control. For example, a control can be a sample, such as a virus, that has a known property or activity.

As used herein, the singular forms "a," "an" and "the" include plural referents unless the context clearly dictates otherwise. Thus, for example, reference to "an" agent includes one or more agents.

As used herein, the term "or" is used to mean "and/or" unless explicitly indicated to refer to alternatives only or the alternatives are mutually exclusive.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

For clarity of disclosure, and not by way of limitation, the detailed description is divided into the subsections that follow.

B. METHODS OF ISOLATING CLONAL VACCINIA VIRUS STRAINS

Provided herein are methods of isolating clonal isolates of a virus from a Vaccinia virus preparation or mixture that has better anti-tumor responses as well as similar or less pathogenicity/toxicity than the starting virus preparation or mixture or other reference strain or isolate. The methods are used in the selection and identification of Vaccinia virus strains that have reduced toxicity and improved or greater anti-tumorigenicity properties compared to existing virus strains.

Vaccinia is used as an oncolytic vector because of its efficient replication, cell lysis, spread, host range and natural tropism for tumor tissues (Shen et al. (2004) *Mol. Ther.*, 11:180). For example, vaccinia virus is more potent in replication and spread than adenovirus vectors. Nevertheless, although vaccinia is a known attenuated virus that has anti-tumorigenicity properties, many existing strains of vaccinia, including recombinant strains, exhibit variations in virulence and safety that make many unsuitable for clinical application. Also, existing oncolytic vaccinia virus candidates are recombinant viruses that contain foreign genes inserted into the viral genome, for example, to minimize toxicity of the virus or to enhance or augment the anti-tumorigenic properties. It is found herein that viruses can be selected that themselves are highly anti-tumorigenic with minimal toxicity in the absence of introduced foreign genes. Thus, for example, a purpose of the method is to select for clonal isolates that have an improved safety profile, including pathogenicity and toxicity, while retaining or also having improved anti-tumorigenicity properties that is independent of insertion of heterologous genes. In particular, the selected clonal strains are oncolytic virus candidates for tumor diagnosis and therapy. The isolated clonal strains of vaccinia can be used as therapeutic viruses for use in the treatment of proliferative disorders, such as cancer, and for use in other therapeutic and/or diagnostic methods as described herein. In addition, the clonal strains also can be used in methods of vaccination. The selected or identified clonal strains also can be used as parental vaccinia viruses in the construction of recombinant oncolytic viruses.

In the method, a parental vaccinia virus preparation or mixture is selected that contains a number of virus particles that have genomes have different genomic sequences. The parental virus preparation or mixture can be any vaccinia virus strain that is a mixed population, i.e. it is non-clonal or not homogenous in sequence. As discussed further below, the preparation can be obtained from repeat propagation of a virus in a culture system. A virus preparation also can be obtained as a mixture by mixing different strains of vaccinia viruses together to allow recombination to occur either in vitro or in vivo. The mixture also can be one obtained from mixing different types of viruses, such as mixing a herpes simplex virus (HSV) strain and a vaccinia virus strain. In the method, the parental virus preparation is propagated or amplified in vitro or in vivo and clonal isolates obtained (e.g. by plaque assay). The isolated and selected virus clones are tested for anti-tumorigenicity and pathogenicity/toxicity in in vitro and/or in vivo assays. One property is not determinative in the selection of an oncolytic candidate, and hence clones are tested for anti-tumorigenicity and toxicity or safety properties. For example, a viral clone that exhibits striking anti-tumorigenic properties, but that is extremely toxic is not an ideal oncolytic candidate. Thus, a balance of these properties is desired. The virus clones with the best antitumor responses but with minimal toxicity are selected as candidates. In particular, the identified or selected virus clone is one that has better toxicity and anti-tumorigenicity properties compared to a reference virus strain.

In one example, viruses selected that have less toxicity compared to the parental virus preparation or other reference virus strain (e.g. recombinant virus) exhibit at or between 0% to 99%, for example, less than 99%, 98%, 97%, 96%, 95%, 90%, 80%, 70%, 60%, 50%, 40%, 30%, 20%, 10%, 5% or less of the toxicity of the parental virus preparation or mixture or other reference virus strain in an assay or method to assess a parameter indicative of toxicity. In other examples, viruses selected that have improved or better anti-tumorigenic activity compared to the parental virus preparation or mixture or other reference virus strain (e.g. recombinant virus) exhibit at or between 120% to 1000%, for example, at least 120%, 130%, 140%, 150%, 160%, 170%, 180%, 190%, 200%, 250%, 300%, 400%, 500%, 1000% or more of the anti-tumorigenic activity of the parental virus preparation or mixture or other reference virus strain in an assay or method to assess a parameter indicative of anti-tumorigenicity. In some examples, virus is selected that retains or has similar toxicity and/or anti-tumorigenic activity compared to the parental virus preparation or mixture or other reference virus strain (e.g. recombinant strain) such as between 70% to 120%, for example, at least or about or 70%, 80%, 90%, 95%, 100%, 110%, 115% or 120% of the toxicity or anti-tumorigenic activity of the parental virus preparation or mixture or other reference virus strain in an assay or method to assess a parameter indicative of toxicity.

A description of the steps of the method is provided in the subsections below. It is understood that the steps set forth below can be performed in any order. For example, parameters indicative of toxicity can be assessed prior to assessing parameters indicative of anti-tumorigenicity of the virus preparation or mixture or individual isolates. In another example, clones can be individually isolated after assessing anti-tumorigenic properties of the virus preparation, thereby preselecting for clones with anti-tumorigenic properties prior to isolation of individual clones. In an alternative example, individual clonal isolates can be isolated from a virus preparation prior to assessing the anti-tumorigenic or virulence properties of each individual clone. In a particular example, the method is performed by selecting a virus preparation or mixture, passaging the preparation or mixture in cell culture and isolating single clones (e.g. by plaque assay in vitro), propagating and purifying each clone from a culture system and assessing each clonal strain for parameters indicative of anti-tumorigenicity and selecting clonal strains that are anti-tumorigenic, and from those selected clonal strains assessing parameters indicative of toxicity and selecting a subset that have minimal toxicity. The steps of assessing anti-tumorigenicity and toxicity can be performed in vitro or in vivo. Typically, selected clonal strains are tested in vivo in animal models for anti-tumorigenic and toxic properties. The genome of the clonal strain can be sequenced to confirm that it is homogenous.

In addition, in selecting or identifying clonal strains with the indicated properties, all or some of the steps of the method can be performed in parallel with a reference strain for comparative purposes to aid in selection of a virus. For example, in the steps of assessing anti-tumorigenicity or toxicity, the anti-tumorigenic or toxic properties of the starting virus preparation or mixture can be assessed, and tested clonal strains can be compared to identify those that retain (i.e. have similar) or that have improved or better anti-tumorigenicity or toxic properties compared to the starting virus preparation or mixture.

In another example, a known attenuated recombinant virus can be assessed for its anti-tumorigenic or toxic properties, and tested clonal isolates can be compared to identify those that have retained (i.e. similar) or that have improved or better anti-tumorigenicity or toxic properties compared to the recombinant virus. Methods for the generation of recombinant viruses using recombinant DNA techniques are well known in the art (e.g., see U.S. Pat. Nos. 4,769,330; 4,603,112; 4,722,848; 4,215,051; 5,110,587; 5,174,993; 5,922,576; 6,319,703; 5,719,054; 6,429,001; 6,589,531; 6,573,090; 6,800,288; 7,045,313; He et al. (1998) *PNAS* 95(5):2509-2514; Racaniello et al. (1981) *Science* 214:916-919; and Hruby et al. (1990) *Clin Micro Rev.* 3:153-170). Attenuated and anti-tumorigenic recombinant vaccinia viruses are known in the art and include, but are not limited to, GLV-1h68 (set forth in SEQ ID NO:9; a derivative of LIVP, see e.g. Zhang et al. (2009) *Mol. Genet. Genomics*, 282:417-435), GLV-1h64 (set forth in SEQ ID NO:326), and any described in published patents or applications (see e.g. U.S. Pub. Nos. US2003-0059400, US2003-0228261, US2009-0117034, US2009-0098529, US2009-0053244, US2009-0081639 and US2009-0136917; U.S. Pat. Nos. 7,588,767 and 7,763,420; and International Pub. No. WO 2009/139921). Other recombinant vaccinia virus strains include, but are not limited to, VVhEA (a derivative of Lister, see e.g. Tysome et al. (2009) *Gene Ther.*, 16:1223-1233), rVV-p53 (a derivative of Lister; see e.g. Timiryasova et al. (1999) *Int. J. Oncol.*, 14:845-854; JX-594 (a derivative of the Wyeth strain, see e.g. Kim et al. (2006) *Mol. Ther.* 14:370) and JX-963 (a derivative of the WR strain, see e.g., Thorne et al. (2007) *J. Clin. Inves.*, 117:3350).

1. Parental Virus Preparation or Mixture

In the methods, a starting or parental preparation of vaccinia virus or mixture of vaccina virus and other virus that does not have a genome that is homogeneous in sequence is selected for use in the method. The vaccinia virus in the preparation or mixed population is typically a non-recombinant virus strain that has not been engineered to contain heterologous genes. Hence, the method permits identification of vaccinia virus clonal strains that exhibit anti-tumorigenicity and minimal toxicity independent of inserted genes. As discussed below, the resulting selected strains can be further modified or engineered by insertion of foreign genes in order to further modulate the properties of the virus.

Typically, the starting preparation or mixture of viruses is or contains an attenuated virus, such as attenuated strains of poxviruses (e.g. vaccinia viruses). A variety of strains of vaccinia viruses are known and available to one of skill in the art. Exemplary vaccinia strains are listed in Table 2 and include, but are not limited to, Lister, Western Reserve (WR), Copenhagen (Cop), Bern, Paris, Tashkent, Tian Tan, Wyeth (DRYVAX), IHD-J, IHD-W, Brighton, Ankara, CVA382, Modified Vaccinia Ankara (MVA), Dairen I, LC16m8, LC16M0, LIVP, ACAM2000, WR 65-16, Connaught, New York City Board of Health (NYCBH), EM-63, or NYVAC vaccinia virus. LIVP is originated from the Lister strain, which was adapted to calf skin in the Institute of Viral Preparations, Moscow, Russia (Al'tshtein et al. (1985) *Dokl Akad Nauk SSSR*, 285:696-699). Western Reserve (WR) is derived from the New York City Board of Health (NYCBH) strain by repeated passages in the mouse brain (Henderson and Moss (1999) Smallpox and Vaccinia. In: Plotkin S, Orenstein W (eds) Vaccines. W.B. Saunders, Philadelphia, pp. 74-97).

TABLE 2

| Name | Abbreviations | Reference (e.g. GenBank Accession No.) |
|---|---|---|
| Vaccinia virus strain Western Reserve | WR | AY243312 |
| Vaccinia virus strain Copenhagen | COP | M35027 |
| Vaccinia Lister major strain | LIST | AY678276 |
| Vaccinia Lister isolate LC16MO | LC | AY678277 |
| Vaccinia Lister clone VACV107 | VACV107 | DQ121394 |
| Vaccinia virus strain ACAM2000 | ACAM | AY313847 |
| Vaccinia virus strain DUKE | DUKE | DQ439815; Li et al. (2006) Virology J, 3: 88 |

TABLE 2-continued

| Name | Abbreviations | Reference (e.g. GenBank Accession No.) |
| --- | --- | --- |
| Vaccinia virus strain Ankara | MVA | U94848 |
| Vaccinia virus Clone3 | CLONE3 | AY138848 |

Virus preparations, including mixed populations, of vaccinia virus that are heterogenous in sequence can be created by a variety of methods known in the art. For example, diversity in the virus preparation can be generated based on homologous recombination events that occur in the natural selection processes of virus strains. For example, it is known that homologous recombination between poxviruses occurs when cells are coinfected with two viruses, or are infected with one virus and genomic DNA or cloned DNA (Plotkin & Orenstein (eds) "Recombinant Vaccinia Virus Vaccines" in Vaccines, $3^{rd}$ edition (1999)). Thus, in one example, virus preparations can be generated by repeated passaging of one or more viral strains in tissue culture or in vivo via infection of tumorous tissues or other mammalian tissue (e.g. passage on calf skin), which can result in accumulation of point mutations or recombination events. In some examples, passaging of two or more viral strains can be made. Methods for the infection of cells in vitro and the in vivo infection of animal subjects with viruses, such as vaccinia viruses are well known in the art. Generation of animal models containing tumors for the passage of a virus or mixtures of viruses also are well known in the art and are described elsewhere herein.

In another example, mutagenesis of one or more viral strains can be effected to create a virus preparation with a variety of genetic modifications. In this example, various mutagenesis strategies of a virus stock can be used to randomly mutagenize a pool of virus. For example, nitrous acid can be used to effect random mutations (see e.g. Williams et al. (1971) *J. Gen. Virol.*, 11:95-101). The resulting virus preparation can be one that has a heterogenous genome.

Typically, the parental virus preparation or mixture is a preparation in which no attempt is made to clonally purify the incoculum before use in the method. In some examples, the virus preparation is obtained by passage of a virus strain one or more times in vivo. In some examples, the virus preparation is obtained by passage one or more times in vitro. In some examples, the virus preparation is obtained by passage one or more times in vitro and an additional one or more times in vivo. In another example, the virus preparation is obtained by propagation of a mixture derived by infecting a culture system with a population of virus strain, such as clonal strains of vaccinia, nonclonal strains of vaccinia, or a combination of clonal and nonclonal strains of vaccinia viruses.

In a particular example, the parental virus preparation or mixture includes a Lister vaccinia virus strain. In another example, the parental virus strain preparation or mixture includes a virus strain derived from a Lister vaccinia virus strain passaged in cell culture. In a particular example, the parental virus strain preparation or mixture is derived from a Lister vaccinia virus strain passaged in cell culture, such as for example, in a tumor cell culture. In a particular example, the parental virus strain preparation or mixture is derived from a Lister vaccinia virus strain passaged in vivo, such as for example, in a grafted tumor. In a particular example, the parental virus strain mixture is derived from a Lister vaccinia virus strain passaged in vivo by cutaneous inoculation of a subject, such as, for example, inoculation of calf skin.

An exemplary parental virus strain preparation or mixture for use in the method herein includes LIVP vaccinia virus that has a genome that is not homogenous in sequence. LIVP originated from the Lister strain (ATCC® Catalog No. VR-1549™), which was adapted to calf skin in the Institute of Viral Preparations, Moscow, Russia (Al'tshtein et al. (1985) *Dokl. Akad. Nauk USSR* 285:696-699). The LIVP strain can be obtained from the Institute of Viral Preparations, Moscow, Russia (Kutinova et al. (1995) Vaccine, 13:487-493); the Microorganism Collection of FSRI SRC VB Vector (Kozlova et al. (2010) Environ. Sci. Technol., 44:5121-5126); or can be obtained from the Moscow Ivanovsky Institute of Virology (C0355 K0602; Agranovski et al. (2006) Atmospheric Environment, 40:3924-3929). It also is well known to those of skill in the art; it is the vaccine strain used for vaccination in the USSR and throughout Asia and India. The strain now is used by researchers and is well known (see e.g., Altshteyn et al. (1985) *Dokl. Akad. Nauk USSR* 285:696-699; Kutinova et al. (1994) *Arch Virol* 134: 1-9; Kutinova et al., (1995) *Vaccine* 13:487-493; Shchelkunov et al., (1993) *Virus Research* 28:273-283; Sroller et al. (1998) *Archives Virology* 143:1311-1320; Zinoviev et al., (1994) *Gene* 147:209-214; Chkheidze et al. (1993) *FEBS* 336:340-342). LIVP exhibits less virulence than the WR strain. A recombinant derivative of LIVP, designated GLV-1h68 (set forth in SEQ ID NO:9; GenBank Acc. No. EU410304) and GLV-1h64 (set forth in SEQ ID NO:326) exhibit tumor targeting properties and an improved safety profile compared to its parental LIVP strain (set forth in SEQ ID NO:10) and the WR strain (Zhang et al. (2009) *Mol. Genet. Genomics*, 282:417-435).

In particular examples, the virus preparation containing a mixed population of vaccinia virus is created by infecting cells or tissues with a vaccinia strain, such as LIVP, and with another virus type or with genomic DNA or cloned DNA. Exemplary of other virus types include, but are not limited to, DNA viruses, such as other poxviruses (e.g. avipox virus, myxoma virus), herpesviruses (e.g., herpes simplex virus (HSV), cytomegalovirus (CMV), Epstein-Barr virus (EBV), hepadnaviruses (e.g., hepatitis B virus), polyoma viruses, papillomaviruses, adenoviruses and adeno-associated viruses; single-stranded DNA viruses, such as parvoviruses; double-stranded RNA viruses, such as reoviruses (e.g., rotavirus); single-stranded positive sense RNA viruses, such as picornoviruses (e.g., Seneca valley virus, coxsackievirus, poliovirus, enteroviruses), togaviruses (e.g., semliki forest virus) and retroviruses (e.g., human immunodeficiency virus (HIV), murine Maloney leukemia virus (MMLV), lentiviruses); single-stranded negative sense RNA viruses, such as orthomyxoviruses (e.g., influenza virus), paramyxoviruses (e.g., Newcastle disease virus, measles virus, mumps virus) and rhabdoviruses (e.g., vesicular stomatitis virus (VSV)).

2. Isolating Clonal Strains

From the virus preparation containing a mixed population of vaccina virus, clonal isolates are selected. Methods to isolate individual clones from a virus mixture are well known to one of skill in the art. Exemplary of such a method is a standard plaque assay. A plaque assay measures the formation of viral plaques, which are areas of viral lysis of cells following infection of a cell monolayers by a virus. Each individual plaque represents a single clonal virus strain.

In a typical plaque assay, cell monolayers are grown to near confluency and then infected with serial dilutions of a virus preparation or mixture as described herein. Infection of cells with virus results in cell lysis and infection of immediately adjacent cells, such that a plaque reflects infection of a group of cells. Generally, each plaque represents a single virus having a homogenous genomic sequence. Serial dilutions of viruses are employed to ensure isolation of well-defined plaques representing single clonal virus strains. Typically, an overlay of agarose is used to keep the cells stable and to limit the spread of virus. Clonal virus strains can be purified by isolating the individual plaques.

Any of a variety of cell types can be used for infection. One of skill in the art can identify appropriate target cell lines for use in a plaque assay. Selection of an appropriate cell line for a plaque assay can depend on known factors, such as, for example, cell infectivity and the ability of the virus to propagate in and lyse the target cell. Exemplary cell lines routinely used for DNA virus infection in plaque assays include, but are not limited to, CV-1 (monkey kidney), Vero (monkey kidney), BHK (hamster kidney), RK13 (rabbit kidney) and HEK-293 (human embryonic kidney) cells. In some examples, the virus can be selected by infection of a cell monolayer of tumor cell line, such as, for example, HT29 (colon), A549 (lung), H2009 (lung), DU145 (prostate), PC-3 (prostate), MB231 (breast), GI-101A (breast), Panc-1 (pancreas), Hlac (head and neck) or other tumor cell line that can form cell monolayers.

In one example, cells are infected with a vaccinia virus preparation or mixture and cell monolayers grown as described. The plaque generally is selected from a plate containing fewer than 50 plaques in order to avoid contamination with virus from other plaques. Once a particular plaque has been selected, the clonal virus strain can be purified by recovery using standard methods. For example, the selected plaque can be picked using a sterile micropipette or tube by removing an agarose plug directly over the plaque into a fresh tube containing tissue culture medium. The virus particles can be eluted out of the agarose by mixing or rotating the tube. The eluted media can be diluted into wells of a cell culture dish or plate containing cells and incubated to allow the virus to propagate. The virus supernatant can be collected and centrifuged to remove debris and stored. Successive passages can be employed for additional stocks, although the number of passages should be minimized and recorded. One or more successive rounds of plaque selection can be employed to ensure isolation of a single clonal virus strain. The identity of the virus can be confirmed by sequencing, restriction analysis, PCR, Southern Blot or by protein expression.

In particular examples of the method herein, clonal virus strains are selected based upon properties desirable for the treatment of tumors or metastases. For example, plaques formed in a plaque assay are formed due to the replicative or infective properties of the virus. The size of the plaques is an indication of the infectivity and viral production. For example, the greater the size of the plaque, the higher the rate of cell lysis and virus spread. For tumor treatment, it is generally desirable that the virus has a high infection rate and/or high rate of lysis of cells. Accordingly, virus plaques that are selected are typically large in size (i.e. large diameter). Thus, in some examples of the method herein, the largest plaques in a plaque assay (e.g. on a plate) are selected. For example, in a selection of plaques, where the plaques differ in size, the largest plaques are selected, such as for example, at least the largest 1, 2, 3, 4, 5, 6, 7, 8, 9, 10 or more, 15 or more, 20 or more, 25 or more plaques are selected. Each selected plaques is isolated, propogated and the clonal virus recovered. Each clonal stock of virus can be tested for anti-tumorigenicity and toxicity.

In another example, prior to isolation of a clonal virus, the virus preparation mixture can be pre-selected for anti-tumorigenicity or toxicity of the virus. For example, preselection can be by passage of the virus mixture in vitro in tumor cell lines (Yan et al. (2003) *J Virol.* 77:2640-2650) or passage in vivo in tumor animal models (Gros et al. (2008) *Cancer Res.* 68:8928) or by passage in vivo in healthy animal models. Various tumor cell lines or tumor animal models are known to one of skill in the art and are described herein. For example, the virus mixture can be used to infect tumor cells in vitro or animals and subject to multiple rounds of selection. For example, for in vitro selection, virus can be serially passaged in tumor cells lines and virus recovered from cells associated with cyopathic effects (CPE). In another example, for in vivo selection, virus can be serially used to infect tumor-bearing animals, body weights and tumor volumes monitored, and virus recovered from the blood or tumor of mice associated with tumor growth inhibition. In a further example, for in vivo selection to preselect for toxicity, the virus can be serially used to infect normal animals, body weights monitored, and virus recovered from the blood of mice associated with minimal decrease in body weight. The recovered virus, which is preselected for its anti-tumorigenicity and/or toxicity properties, then can be isolated using a plaque assay. As above, the largest plaques can be selected to isolate viral clones having high replicative or infective properties.

Following isolation of one or more clonal virus strains from the preparation or mixture of viruses, a clonal virus strain can be further selected as a candidate for therapy based on its anti-tumorigenicity and toxicity properties.

3. Anti-Tumorigenicity

The isolated virus is further tested for parameters indicative of its anti-tumorigenic property. Generally, the parameters selected for are desirable for the treatment of proliferative diseases and disorders, including the treatment of a tumor or metastasis. For example, a virus can destroy tumor cells by replicating such that continual amplification of the virus results in infection of adjacent cells and their subsequent destruction. Oncolytic viruses also exhibit anti-tumorigenicity by expression of proteins that are cytotoxic to cancer cells. In further examples, viruses can exhibit anti-tumorigenicity by initiating specific and nonspecific anti-tumor immune responses, for example, the initiation of cytokine expression from infected cells (e.g. TNF) or through a specific response (e.g. CTL response). Hence, any of the above parameters can be assessed as indicative of anti-tumoriaenicity of a virus.

For example, the isolated virus is tested in one or more further in vitro and/or in vivo assays that assess infectivity, viral nucleic acid replication, virus production, viral gene expression from tumor cells, effects on the host cell, cytotoxicity of tumor cells, tumor cell selectivity, tumor cell type selectivity, specific and nonspecific immune response, and therapeutic efficacy. Parameters indicative of anti-tumorigenicity can be assessed in vitro or in vivo. In particular examples, anti-tumorigenicity is assessed in vivo. In vivo parameters of anti-tumorigenicity include, but are not limited to, a desirable therapeutic index in an animal model of cancer, release of tumor antigens and preferential accumulation of the virus in tumor tissues following administration. Exemplary of assays or methods to assess such parameters are described below.

a. Tumor-Associated Replication Indicator

For selection as a candidate for therapy, the virus generally exhibits replication and/or infectivity in tumor cells. Hence, clonal strains are selected that replicate in tumor cells. The replication indicator that is measured is any parameter from which the level or amount or relative amount of viral replication, typically within a day of administration to the tumor cells, can be assessed or inferred. In some examples, replication can be assessed by measurement of a viral replication indicator, such as, for example, viral titer (i.e. as assessed by the number of plaques produced in a plaque assay) or the changes in viral gene expression or host gene expression (see, e.g. U.S. Patent Pub. No. 2009-0136917). For example, replication can be determined by infecting or introducing the test virus into a tumor cell and assessing a replication indicator at a particular time or as a function of time. This can be compared to a predetermined standard, for example the parental virus preparation or mixture or other reference strain (e.g. recombinant virus), or compared to other test candidate clonal strains. Viruses are selected that replicate in a tumor cell as assessed in vitro or in vivo. In particular examples, viruses are selected that selectively replicate in tumor cells compared to normal cells.

Assays to assess replication can be performed on cell lysates of virus propagated in vitro in various tumor cell lines, primary tissues or cells as well as tumor cells such as from a biopsy. For example, a tissue or cell sample can be obtained (e.g., biopsy) from a subject (e.g., human or non-human animal subject), and the sample can be infected with one or more types of viruses. In other examples, tumor cell lines can be used. Tumor cell lines are known and available to one of skill in the art, for example, from the American Type Culture Collection (ATCC®; Manassas, Va.) or from the European Collection of Cell Cultures (ECACC). Tumor cell lines also are available from the Division of Cancer Treatment and Diagnosis (DCTD) Tumor Repository (National Cancer Institute/National Institute of Health; dtp.nih.gov/index.html.) Exemplary of tumor cell lines include human and other animal cells lines and include, but are not limited to, DU145 human prostate carcinoma cells, LNCaP human prostate cancer cells, MCF-7 human breast cancer cells, MRC-5 human lung fibroblast cells, MDA-MB-438 human breast cancer cells, MDA-MB-231 human breast carcinoma cells, PC3 human prostate cancer cells, T47D human breast cancer cells, THP-1 human acute myeloid leukemia cells, U87 human glioblastoma cells, SH-SY5Y human neuroblastoma cells, Saos-2 human cells, A549 human lung carcinoma cells, A2780 human ovarian carcinoma cells, HCT 116 human colon cells, HT-29 human colon cells, SW260 human colon cells, HT-180 human fibrosarcoma, MIA PaCa-2 human pancreatic carcinoma cells, PANC-1 human pancreatic cells, CMT 64 C57BL/6 mouse cell, JC mouse mammary cells, TIB-75 mouse hepatic cells, CT26 WT mouse colon carcinoma cells, MC-38 mouse adenocarcinoma cells, B16-F10 mouse melanoma cells, 4T1 murine mammary carcinoma cells and hamster pancreatic tumor HP-1 cells.

For example, cells or cell lines can be seeded onto wells of a plate. Virus can then be added and allowed to infect the cells. At the end of the infection, the media can be changed to remove any residual virus and the cells further incubated. Then, the cells can be scraped into the media and collected. Cells can be lysed, for example, by freeze-thaw and/or sonication, to obtain virus-containing lysates. The extent of replication can be measured, such as by determination of viral titer or expression of genes as described further below.

It is understood that the extent and degree of replication and/or infectivity efficiency of a virus will differ between various tumor cell types.

Assays to assess replication also can be performed on tumor-harvested virus propagated in vivo upon infection of tumor-bearing animals. Such an assay is a measure of the accumulation of the virus in tumor tissues. As discussed below, tumors can be established in animals by implantation of different tumor cell types. For example, tumor-bearing animals can be infected with virus, virus propagated in tumors and virus or tumor extracted therefrom. The extent of replication can be measured, such as by determination of viral titer or expression of genes, as described further below.

In one example, cell culture supernatants or cell lysates from the infected cells or tumor cell extracts can be obtained following infection and subjected to assays to measure viral titer. For example, a standard plaque assay can be used. The plaque assay can indicate the biological activity in different cell types, including different tumor cell types. Titration of virus by plaque assay is known to one of skill in the art. In one example of a plaque assay, supernatants or cells lysates of tumors or cells infected with the virus is harvested and plaque assays can be performed. Typically, serial dilutions of the virus supernatant or lysate is made in the range of $10^{-2}$ (1:100) to $10^{-10}$, and in particular from $10^{-5}$ to $10^{-10}$. Diluted virus is added to a monolayer of cells, for example, monolayers of permissive cell line, such as, for example, CV-1, Vero, BHK, RK13 or HEK-293 cell line, and incubated with virus. In some examples, the plaque assay can be performed directly on a cell monolayer of a tumor cells provided that the tumor cells can form a monolayer. Following incubation, an agarose overlay is added to the monolayer of cells without dislodging the cells, and the plate is further incubated until plaques become visible. A dye or color stain solution that is taken up by healthy cells but not dead cells, such as neutral red, is added to each of the wells or plate. After incubation, the dye or stain is removed such that the plaques are observed to be clear, while non-lysed cells remain stained. Titer (pfu/mL) is calculated by counting the number of plaques in the well and dividing by the dilution factor (d) and the volume (V) of diluted virus added to the well (#plaques/d×V). The virus yield can be converted to pfu/cell by dividing the total amount of virus present in the sample by the number of cells originally infected in the sample.

Generally, in the method herein, virus is selected for as exhibiting a parameter indicative of anti-tumorigenicity if the pfu/ml is or is about between $1\times10^2$ to $1\times10^{10}$, such as $5\times10^3$ to $1\times10^9$, for example $1\times10^4$ to $1\times10^8$, and in particular is at or at least $1\times10^3$, $1\times10^4$, $1\times10^5$, $1\times10^6$, $1\times10^7$, $1\times10^8$, or $1\times10^9$. In other examples, in the method herein, virus is selected for as exhibiting a parameter indicative of anti-tumorigenicity if the pfu/cell is or is about between 2 to 10000, such as, 10 to 5000, for example 100 to 2000, and in particular at or at least 10, 100, 200, 300, 400, 500, 600, 700, 800, 900, 1000, 2000, 3000, 4000, 5000 or more. Typically, virus is selected for as exhibiting a parameter indicative of anti-tumorigenicity if the replication (pfu/ml or pfu/cell) is similar to or better than a reference virus preparation or mixture or other reference virus (e.g. recombinant protein) as described herein above.

Other indicators of replication also can be assessed. For example, expression of viral genes, tumor proteins and/or housekeeping genes that are correlated with viral replication and/or infectivity in tumor cells can be assessed (see e.g. U.S. Patent Pub. No. 2009-0136917). For example, expression of housekeeping genes or other genes in tumor cells associated with virus replication and infectivity can be assessed (U.S. Patent Pub. No. 2009-0136917). For example, expression of a plurality of such genes, such as housekeeping genes, whose expression increases in tumor cells upon infection with virus are assessed. Exemplary of such genes that can be assessed include expression of one or more genes encoding a protein selected from among IL-18 (Interleukin-18), MCP-5 (Monocyte Chemoattractant Protein-5; CCL12), IL-11 (Interleukin-11), MCP-1 (Monocyte Chemoattractant Protein-1), MPO (Myeloperoxidase), Apo A1 (Apolipoprotein A1), TIMP-1 (Tissue Inhibitor of Metalloproteinase Type-1), CRP (C Reactive Protein), Fibrinogen, MMP-9 (Matrix Metalloproteinase-9), Eotaxin (CCLI11), GCP-2 (Granulocyte Chemotactic Protein-2; CXCL6), IL-6 (Interleukin-6), Tissue Factor (TF), SAP (Serum Amyloid P), FGF-basic (Fibroblast Growth Factor-basic), MCP-3 (Monocyte Chemoattractant Protein-3; CCL7), IP-10 (CXCL 10), MIP-2, Thrombopoetin, Cancer antigen 125, CD40, CD40 ligand, ENA-78, Ferritin, IL-12p40, IL-12p70, IL-16, MMP-2, PAI-1, TNF RII, TNF-beta and VCAM-1. In another example, expression of a plurality of genes, such as housekeeping genes, whose expression decreases in tumor cells upon infection with virus are assessed. Exemplary of such genes include one or more genes encoding a protein selected from among MIP-1beta (Macrophage Inflammatory Protein-1beta), MDC (Macrophage-Derived Chemokine; CCL22), MIP-1alpha (Macrophage Inflammatory Protein-1alpha; CCL3), KC/GROalpha (Melanoma Growth Stimulatory Activity Protein), VEGF (Vascular Endothelial Cell Growth Factor), Endothelin-1, MIP-3 beta (Macrophage Inflammatory Protein-3 beta; Exodus-3 or ELC), Beta-2 microglobulin, IL-5 (Interleukin-5), IL-1 alpha (Interleukin-1 alpha), EGF (Epidermal Growth Factor), Lymphotactin (XCL1), GM-CSF (Granulocyte Macrophage-Colony Stimulating Factor), MIP-1gamma (Macrophage Inflammatory Protein-1gamma; CCL4), IL-1beta (Interleukin-1 beta), BDNF (Brain-derived neutrophic factor), Cancer antigen 19-9, Carcinoembryonic antigen, C reactive protein, EGF, Fatty acid binding protein, Factor VII, Growth hormone, IL-1 alpha, IL-1 beta, IL-1 ra, IL-7, IL-8, MDC, Prostatic acid phosphatase, Prostate specific antigen, free, Stem cell factor, Tissue factor, TNF-alpha, VEGF and Von Willebrand factor.

Gene expression can be assayed after contacting a tumor sample with the virus for a period of time in vitro or in vivo and measuring the level of expression of one or more housekeeping genes or other genes. Any method known in the art can be used for assessing the expression of genes in a tumor can be employed. For example, methods for measuring protein expression levels which can be used include, but are not limited to, microarray analysis, ELISA assays, Western blotting, or any other technique for the quantitation of specific proteins. For RNA levels, examples of techniques which can be used include microarray analysis, quantitative PCR, Northern hybridization, or any other technique for the quantitation of specific nucleic acids. In some examples, a difference in expression of the same marker between the contacted and non-contacted biological samples of about less than 2-fold, about 2-fold, about 3-fold, about 4-fold, about 5-fold, about 6-fold, about 7-fold, about 8-fold, about 9-fold, about 10-fold, about 20-fold, about 30-fold, about 40-fold, about 50-fold, about 60-fold, about 70-fold, about 80-fold, about 90-fold, about 100-fold or greater than about 100-fold is indicative of specific replication and/or infectivity of a tumor cell. In the method herein, virus is selected for as exhibiting a parameter indicative of anti-tumorigenicity if the replication (increased or decreased gene expression) is similar to or better than a reference virus preparation or mixture or other reference virus (e.g recombinant protein).

For comparison of virus infection and replication rates, the assays are typically performed over time. For example, samples for assessment of virus replication are typically obtained at selected time points following virus infection of the cells, such as, for example, 1 hour, 2 hours, 4 hours, 8 hours, 16 hours, 24 hours, 1.5 days. 2 days, 2.5 days, 3 days, 4 days, 5 days, 6 days or more. One of skill in the art can select appropriate time points for assessment of viral replication based on the relative infectivity of the virus compared to other known virus strains.

Delays in replication between and among test viruses and the parental virus preparation or mixture or other reference or standard virus can be determined. Viruses that exhibit delayed replication in a tumor cell following infection of the tumor cell are predicted to not be effective for therapy of the particular cell type. Likewise, efficient and early replication of the virus following infection of a tumor cell in vitro or in vivo is indicative of a favorable response to tumor therapy by the virus in vivo. Thus, viruses that exhibit a non-delayed replication profile are generally desirable for selection as a candidate virus for therapy of a proliferative diseases and disorders. The particular time value to select can be empirically determined if necessary. Thus, the replication indicator can be determined and, for example, can be compared to a standard indicative of delayed replication or non-delayed replication. The standard can be pre-determined, such as a database of values of the indicator that represent non-delayed replication or delayed replication. Thus, for example, the replication indicator can be compared to a database of predetermined values for tumor cell types to determine whether the replication indicator has a value indicative of non-delayed replication (see e.g. U.S. Patent Pub. No. 2009-0136917).

Varying doses/multiplicity of infection (M01; ratio of virus to cell) of the virus can be assessed in order to assess the rate of viral infection and virus production at different infection levels. Viruses that exhibit a high rate of replication at a lower MOI are generally desirable for selection as a candidate virus for therapy of a proliferative disorder or disease. For example, cells can be infected at an MOI of at or between 0.1 to 10, such as 0.5 to 5, for example, 0.5 to 2, for example, an MOI of at or at least 0.25, 0.5, 1, 1.5, 2 or more.

In any of the examples herein assessing replication or infectivity of a virus, tumor cell selectivity of the virus also can be assessed. For example, normal cells and tumor cells can be infected with virus followed by assessment of replication and or infectivity using any of the assays described herein or known to one of skill in the art. For example, measurement of viral titer by plaque assay or by expression of genes as described below can be determined in virally-infected tumor cells versus virally-infected normal cells. Normal or non-transformed cells include, but are not limited to, MRC-5 lung fibroblast cells, Beas-2B bronchial epithelial cells, normal human bronchial epithelial (NHBE), small airway bronchial epithelial (SAEC). Tumor cells include any described herein or known to one of skill in the art and include, but are not limited to, A2780, A549, HCT 116, HT 1080, LNCaP or SW620 cells. In some examples, paired tumor and non-tumor cell lines can be infected with virus and compared. Exemplary corresponding or paired tumor and non-tumor cell lines are known to one of skill in the art (see e.g., Gazdar et al. (1998) *Int. J. Cancer*, 78:766-774, Theodore et al. (2010) *Int. J Oncology*, 37:1477-1482; Niedbala et al. (2001) *Radiation Research*, 155:297-303). In other examples, tumors infected in vivo can be harvested and can be compared to normal cells or tissues that also are extracted from the same infected animal. Infection and replication of virus in normal cells and tumor cells can be assessed and compared. The therapeutic index of the virus can be determined by the ratio of replication in the tumor cell compared to the normal cell (e.g. virus produced per cell; pfu/cell). In the method herein, viruses are selected with a therapeutic index or ratio that is or is about 2 to 5000, such as 10 to 5000, for example 100 to 2000, and in particular at least 100, 200, 300, 400, 500, 600, 700, 800, 900, 1000, 2000, 3000, 4000, 5000, for example, at least 1000 or at least 2000.

b. Cytotoxicity

For selection as a candidate for therapy, the virus generally exhibits cytotoxic cytopathic activity against tumor cells. Hence, clonal strains are selected that are cytotoxic or kill tumor cells. The clonal isolates can be selected for their ability to eliminate tumor cells via induction of cell death and/or lysis of the tumor cell (i.e. oncolysis). The cell killing activity of the virus can be assessed by a variety of techniques known in the art including, but not limited to, cytotoxicity/cell viability assays that can be employed to measure cell necrosis and/or apoptosis following virus infection, such as MTT (3-(4,5-dimethylthiazol-2-yl)-2,5-diphenyltetrazolium bromide) assays and other related tetrazolium salt based assays (e.g. XTT, MTS or WST), ATP assays, apoptosis assays, such as TUNEL staining of infected cells, DNA fragmentation assays, DNA laddering assays, and cytochrome C release assays. Such assays are well known to one of skill in the art.

For example, viability of virally-infected cells can be assessed. Various tumor cell lines, for example any described above or known to one of skill in the art, can be seeded in a 96-well plate (e.g. at or about 5,000 cells/well) or other size well-plate and grown overnight, and then can be infected with serial dilution of virus. For example, various MOI of the virus can be tested. MOI can range from, for example, 1000 to 0.0001, such as 100 to 0.001 or 10 to 0.01. It is within the level of one of skill in the art to empirically select or determine an appropriate MOI range in which to use. Once infected, the cells can be incubated for a period of time before assessment of cytotoxicity. For example, samples for assessment of cytotoxicity are typically obtained at selected time points following virus infection of the cells, such as, for example, 1 hour, 2 hours, 4 hours, 8 hours, 16 hours, 24 hours, 1.5 days. 2 days, 2.5 days, 3 days, 4 days, 5 days, 6 days or more. One of skill in the art can select appropriate time points for assessment of viral replication based on the relative infectivity of the virus compared to other known virus strains. Generally, infection is allowed to proceed at least 12 hours, 24 hours, 36 hours, 48 hours, 72 hours, 84 hours, 96 hours or more.

Following infection for the designated period, media is replaced and viability of the cells is determined based on any assay or procedure known to one of skill in the art. Exemplary of assays to assess viability are colorimetric assays that permit visualization of cells based on metabolic activity and measure the reducing potential of the tetrazolium salt to a colored formazan product (e.g. MTT assay, MTS assay or XTT assay). Other redox assays include assays that measure the ability of cells to convert a redox dye resazurin to a fluorescent end product resorufin (McMillian et al. (2002) Cell Biol. Toxicology, 18:157-173; CellTiter-Blue™ Cell Viability Assay, Promega). In other examples, viability can be assessed using a CASY® cell counting technology, which is an electric field multi-channel cell counting system based on existence of a transmitted electric field through injured or dead cells as compared to normal cells (e.g. CASY® Model TT; Roche Innovatis AG). Additional examples include, but are not limited to, trypan blue or propidium iodide dye exclusion assay, measurement of lactate dehydrogenase (LDH; see e.g., LDH Cytotoxicity Detection Kit, Clontech, Cat. #630117), sulforhodamine B (SRB) assay (e.g. CytoScan™ SRB Cytotoxicity Assay, GBiosciences, Cat. No. 786-213, WST assay (e.g. Cytoscan™ WST-1 Cell Proliferation Assay, GBiosciences, Cat No. 786-212), clonogenic assay and luciferase-based ATP-based assays (e.g., CelTiter-Glo™ Luminexcent Cell Viability Assay; Promega).

Generally, the assays are performed using various controls. For example, any assay to assess viability generally is performed with untreated wells containing cells only (e.g. 100% viable) as well as cell-free wells (0% viable). Also, in addition to the clonal strain tested wells, other control viruses can be tested. For example, the starting virus preparation or mixture can be tested for its cytotoxic effects. In another example, a reference virus strain, for example, a known attenuated recombinant strain can be tested. Exemplary of such as strain is GLV-1h68 or a derivative thereof containing inserted heterologous genes. In examples where virus is added as a control, the MOI range of virus that is used is the same as the tested virus clonal isolate.

A virus is selected that exhibits a cytopathic or cytotoxic effect. For example, a test clonal strain is selected as exhibiting a cytopathic effect if it is determined to exhibit a reduction in cell viability relative to an untreated well containing cells only (100% viable). In other examples, a test clonal strain is selected as exhibiting a cytopathic effect if it is determined to exhibit a reduction in cell viability relative to the viability of cells in a well treated with the parental viral mixture. In a further example, a test clonal strain is selected as exhibiting a cytopathic effect if it is determined to exhibit a reduction in cell viability relative to the viability of cells in a well treated with a known reference attenuated virus strain, such as an attenuated recombinant virus (e.g. GLV-1h68 or derivative thereof). In any of the examples above, a test clonal strain is selected as exhibiting cytotoxicity if, at a given MOI, the cell viability is less than 100% of the viability of control cells (untreated cells, virus mixture-treated or control virus strain-treated), such as or between about 0% to 99% of the viability of control treated cells.

A reduction or decrease in cell viability means that the tested clonal isolate exhibits increased cytotoxicity compared to the control treated cells. The cytotoxicity can be determined as a ratio of cell viability of the control treated cells compared to the tested clonal strain treated cells (percent viable control-treated cells/percent viable tested clonal strain-treated cells). A clonal virus strain is selected that exhibits a ratio of cytotoxicity that is greater than 1.0, for example, that is greater than 1.1, 1.2, 1.3, 1.4, 1.5, 1.6, 1.7, 1.8, 1.9, 2, 3, 4, 5, 6, 7, 8, 9, 10, 20, 30, 40, 50, 60, 70, 80. 90 or 100. In particular examples, the results are presented as the MOI at which 50% of the cell layer is viable ($ED_{50}$). The cytotoxicity can be determined as a ratio of $ED_{50}$ of the control treated cells compared to the tested clonal strain treated cells ($ED_{50}$ control-treated cells/$ED_{50}$ tested clonal strain-treated cells). A clonal virus strain is selected that exhibits a ratio of cytotoxicity that is greater than 1.0, for example, that is greater than 1.1, 1.2, 1.3, 1.4, 1.5, 1.6, 1.7, 1.8, 1.9, 2, 3, 4, 5, 6, 7, 8, 9, 10, 20, 30, 40, 50, 60, 70, 80. 90, $10^2$, $10^3$, $10^4$, $10^5$, $10^6$ or more. It is understood that a ratio of activity that is 1.2 or 5 and so on means that the virus exhibits 120% or 500% and so on of the cytotoxicity of the reference or control.

c. Tumor Growth

For selection as a candidate for therapy, a virus is selected as exhibiting a parameter indicative of anti-tumorigenicity if it causes shrinkage of tumor size and/or delays tumor progression. Hence, clonal strains are selected that exhibit a decrease tumor growth or size. Tumor size can be assessed in vivo in tumor-bearing human or animal models treated with virus. Tumor shrinkage or tumor size can be assessed by various assays known in art, such as, by weight, volume or physical measurement.

Tumor-bearing animal models can be generated. In vivo tumors can be generated by any known method, including xenograft tumors generated by inoculating or implanting tumor cells (e.g. by subcutaneous injection) into an immunodeficient rodent, syngeneic tumors models generated by inoculating (e.g. by subcutaneous injection) a mouse or rat tumor cell line into the corresponding immunocompetent mouse or rat strain, metastatic tumors generated by metastasis of a primary tumor implanted in the animal model, allograft tumors generated by the implantation of tumor cells into same species as the origin of the tumor cells, and spontaneous tumors generated by genetic manipulation of the animal. The tumor models can be generated orthotopically by injection of the tumor cells into the tissue or organ of their origin, for example, implantation of breast tumor cells into a mouse mammary fat pad. Any of the above models provide a consistent and reproducible tool for evaluating tumor cell growth, as well as permitting easy access to assess the mass of the tumor.

In particular examples, xenograft models or syngenic models are used. For example, tumors can be established by subcutaneous injection at the right armpit with a cell suspension (e.g. $1\times10^6$ to $5\times10^6$ cells/animal) of different tumor cell types into immunocompetent hosts (syngeneic) or immunodeficient hosts (e.g. nude or SCID mice; xenograft). Exemplary human tumor xenograft models in mice, such as nude or SCID mice, include, but are not limited to, human lung carcinoma (A549 cells, ATCC® No. CCL-185™); human breast tumor (GI-101A cells, Rathinavelu et al., Cancer Biochem. Biophys., 17:133-146 (1999)); human ovarian carcinoma (OVCAR-3 cells, ATCC® No. HTB-161™; human pancreatic carcinoma (PANC-lcells, ATCC® No. CRL-1469™ and MIA PaCa-2 cells, ATCC® No. CRL-1420™); DU145 cells (human prostate cancer cells, ATCC® No. HTB-81™); human prostate cancer (PC-3 cells, ATCC® #CRL-1435™); colon carcinoma (HT-29 cells); human melanoma (888-MEL cells, 1858-MEL cells or 1936-MEL cells; see e.g. Wang et al., (2006) J. Invest. Dermatol. 126:1372-1377); and human fibrosarcoma (HT-1080 cells, ATCC® No. CCL-121™) and human mesothelioma (MSTO-211H cells). Exemplary rat tumor xenograft models in mice include, but are not limited to, glioma tumor (C6 cells; ATCC® No. CCL-107™). Exemplary mouse tumor homograft models include, but are not limited to, mouse melanoma (B16-F10 cells; ATCC® No. CRL-6475™). Exemplary cat tumor xenograft models in mice include, but are not limited to, feline fibrosarcoma (FC77.T cells; ATCC® No. CRL-6105™). Exemplary dog tumor xenograft models in mice include, but are not limited to, canine osteosarcoma (D17 cells; ATCC® No. CCL-183™). Non-limiting examples of human xenograft models and syngeneic tumor models are set forth in the Tables 3 and 4 below.

TABLE 3

Human Tumor Xenograft Models

| Tumor Type | Cell Line Name | Tumor Type | Cell Line |
|---|---|---|---|
| Adenoid cystic carcinoma | ACC-2 | Leukemia | HL-60 |
| Bladder carcinoma | EJ | Liver carcinoma | Bel-7402 |
| Bladder carcinoma | T24 | Liver carcinoma | HepG-2 |
| Breast carcinoma | BCaP-37 | Liver carcinoma | QGY-7701 |
| Breast carcinoma | MX-1 | Liver carcinoma | SMMC7721 |
| Cervical carcinoma | SiHa | Lung carcinoma | A549 |
| Cervical carcinoma | Hela | Lung carcinoma | NCI-H460 |
| Colon carcinoma | Ls-174-T | Melanoma | A375 |
| Colon carcinoma | CL187 | Melanoma | M14 |
| Colon carcinoma | HCT-116 | Melanoma | MV3 |
| Colon carcinoma | SW116 | Ovary carcinoma | A2780 |
| Gastric carcinoma | MGC-803 | Pancreatic carcinoma | BXPC-3 |
| Gastric carcinoma | SGC-7901 | Prostate carcinoma | PC-3M |
| Gastric carcinoma | BGC-823 | Tongue carcinoma | Tca-8113 |
| Kidney carcinoma | Ketr-3 | | |

TABLE 4

Syngeneic Mouse Tumor Model

| Tumor Type | Cell Line Name | Strain of Mice |
|---|---|---|
| Cervical carcinoma | U14 | ICR |
| Liver carcinoma | H22 | ICR |
| Lung carcinoma | Lewis | C57BL6 |
| Melanoma | B16F1, B16F10, B16BL6 | C57BL6 |
| Sarcoma | S180 | ICR |

Tumor size and volume can be monitored based on techniques known to one of skill in the art. For example, tumor size and volume can be monitored by radiography, ultrasound imaging, necropsy, by use of calipers, by microCT or by $^{18}$F-FDG-PET. Tumor size also can be assessed visually. In particular examples, tumor size (diameter) is measured directly using calipers. In other examples, tumor volume can be measured using an average of measurements of tumor diameter (D) obtained by caliper or ultrasound assessments. The volume can be determined from the formula $V=D^3\times\pi/6$ (for diameter measured using calipers) or $V=D^2\times d\times\pi/6$ (for diameter measured using ultrasound where d is the depth or thickness). For example, caliper measurements can be made of the tumor length (1) and width (w) and tumor volume calculated as length×width$^2$×0.52. In another example, microCT scans can be used to measure tumor volume (see e.g. Huang et al. (2009) PNAS, 106:3426-3430). In such an example, mice can be injected with Optiray Pharmacy loversol injection 74% contrast medium (e.g. 741 mg of loversol/mL), mice anesthetized, and CT scanning done using a MicroCat™ 1A scanner or other similar scanner (e.g. IMTek) (40 kV, 600 µA, 196 rotation steps, total angle or rotation=196). The images can be reconstructed using software (e.g. RVA3 software program; ImTek). Tumor volumes can be determined by using available software (e.g. Amira 3.1 software; Mercury Computer Systems™).

Once the implanted tumors reach a predetermined size or volume, the models can be used for treatment with virus. The exact final tumor volume can be empirically determined and is a function of the particular type of tumor as well as the end-point of the analysis. Generally, mice are sacrificed if the tumor volume is greater than 3 cm$^3$.

Tumor-bearing animals are infected with virus. The route of administration for infection can be intraperitoneal, such as subcutaneous, or can be intratumoral or intravenous. The virus can be administered at varying dosages. For example, the virus can be administered to tumor-bearing animals at or between about $1\times10^4$ to $1\times10^8$ pfu, such as $1\times10^5$ to $1\times10^7$ pfu, for example at least or about or $1\times10^6$, $2\times10^6$, $3\times10^6$, $4\times10^6$ or $5\times10^6$ pfu. Progressing tumors are visualized and tumor size and tumor volume can be measured using any technique known to one of skill in the art. For example, tumor volume or tumor size can be measured using any of the techniques described herein. Tumor volume and size can be assessed or measured at periodic intervals over a period of time following virus infections, such as, for example, every hour, every 6 hours, every 12 hours, every 24 hours, every 36 hours, every 2 days, every 3 days, every 4 days, every 5 days, every 6 days, every 7-days, every week, every 3 weeks, every month or more post-infection. A graph of the median change in tumor volume over time can be made and the total area under the curve (AUC) can be calculated. This is exemplified in Example 4. A therapeutic index also can be calculated using the formula ($AUC_{untreated\ animals} - AUC_{virus\text{-}treated\ animals})/AUC_{untreated}\times100$.

Generally, tumor-bearing animals generated in the same manner, at the same time and with the same type of tumor cells are used as controls. Such control tumor-bearing animals include those that remain untreated (not infected with virus). Additional control animals include those infected with the parental virus preparation or mixture or with a reference virus strain, such as a known attenuated recombinant strain. Exemplary of such a strain is GLV-1h68 or a derivative thereof containing inserted heterologous genes. In examples where tumor-bearing animals are infected with the parental virus preparation or mixture or other reference strain as a control, the amount of virus administered (e.g. pfu) is the same as the tested virus clonal strain.

A virus is selected that mediates a decrease in tumor size (e.g. diameter), volume or weight compared to control treated or untreated tumor-bearing animals. It is understood that a decrease in tumor size, volume or weight compared to control treated or untreated tumor-bearing animals means that the virus itself is mediating tumor regression or shrinkage or that the virus is mediating delayed tumor progression compared to control treated or untreated tumor-bearing animals. Tumor shrinkage or delay in tumor progression are parameters indicative of anti-tumorigenicity.

For example, a tested clonal strain is selected as mediating a decrease in tumor size or volume based on visual assessment of tumor size in the animal compared to control treated or untreated tumor-bearing animals. In other examples, a tested clonal strain is selected as mediating a decrease in tumor size or volume if the tumor size is decreased in diameter as assessed by any measurement known in the art (e.g. use of calipers) compared to an untreated tumor-bearing animal or compared to a tumor-bearing animal treated with the parental virus mixture or with another reference virus strain (e.g. attenuated recombinant virus). In a further example, a tested clonal isolate is selected as mediating a decrease in tumor size or volume if the tumor volume is decreased as assessed by any technique known to one of skill in the art compared to an untreated tumor-bearing animal or compared to a tumor-bearing animal treated with the parental virus preparation or mixture or with another reference virus strain (e.g. attenuated recombinant virus). It is understood that comparison of tumor size or volume can be made at any predetermined time post-infection, and can be empirically determined by one of skill in the art. In some examples, a comparison can be made at the day in which the untreated control is sacrificed. In other examples, analysis of the total AUC can be made, and AUC values compared as an indicator of the size and volume of the tumor over the time period of infection.

Effects of a virus on tumor size or volume can be presented as a ratio of tumor size or volume at a designated time post-infection of the control treated animal compared to the tested clonal strain-treated animal (tumor size or volume of control-treated animals/tumor size or volume of clonal isolate-treated animals). A clonal virus is selected that exhibits a ratio of tumor shrinkage that is greater than 1.0, for example, that is greater than 1.1, 1.2, 1.3, 1.4, 1.5, 1.6, 1.7, 1.8, 1.9, 2, 3, 4, 5, 6, 7, 8, 9, 10, 20, 30, 40, 50 or more. In particular examples, the results are presented as a ratio of the total AUC area during the course of treatment (AUC of tumor size or volume of control-treated animals/AUC tumor size or volume of clonal isolate-treated animals). A clonal virus is selected that exhibits a ratio of tumor shrinkage as measured by AUC that is greater than 1.1, 1.2, 1.3, 1.4, 1.5, 1.6, 1.7, 1.8, 1.9, 2, 3, 4, 5, 6, 7, 8, 9, 10, 20, 30, 40, 50 or more. It is understood that a ratio of 1.2 or 5 and so on means that the virus effects a decreased tumor size or volume and exhibits 120% or 500% and so anti-tumorigenicity activity compared to the reference or control.

In particular examples, the therapeutic index is determined as a measure of effects of a virus on tumor size or volume. A clonal virus is selected that exhibits a therapeutic index that is at least or about at least or 120%, 130%, 140%, 150%, 160%, 170%, 180%, 190%, 200%, 250%, 300%, 400%, 500%, 600%, 700%, 800% or more compared to the therapeutic index of the parental virus preparation or mixture or a control reference virus strain (e.g. attenuated recombinant virus).

In additional examples, tumors can be harvested from the animals and weighed. Virus can be selected that result in a decreased weight of the tumor compared to tumor harvested from control tumor-bearing animals that were not infected with virus. The weight also can be compared to tumors harvested from control treated animals at the same time post-infection. The change in weight can be presented as a ratio of the tumor weight (tumor weight control treated animals/tumor weights of clonal isolate-treated animals). A clonal virus is selected that exhibits a ratio of tumor weight that is greater than 1.0, for example, that is greater than 1.1, 1.2, 1.3, 1.4, 1.5, 1.6, 1.7, 1.8, 1.9, 2, 3, 4, 5, 6, 7, 8, 9, 10, 20, 30, 40, 50 or more. It is understood that a ratio of tumor weight that is 1.2 or 5 and so on means that the virus effects a decreased tumor weight and 120% or 500% and so on anti-tumorigenicity activity compared to the reference or control.

In further examples, the harvested tumors can be lysed. For example, lysis of tumors can be by freeze thaw of the harvested tumor several times (e.g. at least 2 times, 3 times or 4 times) shortly after removal of the tumor from the animal. For example, the tumor is lysed by 3 freeze thaw cycles within 2 hours of removal. The virus in the tumor lysates can be tittered as described above and the amount of virus in each tumor sample determined. In some examples, the virus titer can be expressed as tissue culture infectious dose normalized to the tissue weight ($TCID_{50}$/mg tissue).

In particular examples, the effect of the virus on other organs or tissues in the animal can be assessed. For example, other organs can be harvested from the animals, weighed and/or lysed for viral titer determination.

4. Toxicity/Safety

The isolated virus is further tested for parameters indicative of its toxicity/safety property. Viruses can be toxic to their hosts by manufacturing one or more compounds that worsen the health condition of the host. Toxicity to the host can be manifested in any of a variety of manners, including septic shock, neurological effects, or muscular effects. The viruses provided herein are selected that have a reduced toxicity to the host. The reduced toxicity of a virus of the present methods and compositions can range from a toxicity in which the host experiences no toxic effects, to a toxicity in which the host does not typically die from the toxic effects of the microbes.

Parameters indicative of toxicity or safety of a virus can be tested in vitro or in vivo. Typically, assessment is in vivo. Exemplary methods include administration of the virus to a subject (e.g. animal model) and assessment of one or more properties associated with toxicity including, but not limited to, survival of the subject, decrease in body weight, existence of side effects such as fever, rash or other allergy, fatigue or abdominal pain, induction of an immune response in the subject, tissue distribution of the virus, amount of tumor antigens that are released and decreased rate of pock formation. Hence, any of the above parameters can be assessed as indicative of toxicity/safety of a virus. Viruses are selected that exhibit minimal toxicity.

As above, subjects (e.g. animals such as tumor-bearing animal models) are infected with virus. The route of administration for infection can be intraperitoneal, such as subcutaneous, or can be intratumoral or intravenous. The virus can be administered at varying dosages. For example, the virus can be administered to tumor-bearing animals at or between about $1\times10^4$ to $1\times10^8$ pfu, such as $1\times10^5$ to $1\times10^7$ pfu, for example at least or about or $1\times10^6$, $2\times10^6$, $3\times10^6$, $4\times10^6$ or $5\times10^6$ pfu. For humans, the virus can be administered at or between about $1\times10^7$ to $1\times10^{14}$ pfu, such as $1\times10^7$ to $1\times10^{10}$ pfu or $1\times10^9$ to $1\times10^{10}$ pfu, for example at least or about $1\times10^9$, $2\times10^9$, $3\times10^9$, $4\times10^9$, or $5\times10^9$ pfu Parameters indicative of toxicity such as the survival and weight of the subject can be monitored over time. For example, survival and weight can be monitored at periodic intervals over a period of time following virus infections, such as, for example, every hour, every 6 hours, every 12 hours, every 24 hours, every 36 hours, every 2 days, every 3 days, every 4 days, every 5 days, every 6 days, every 7-days, every week, every 3 weeks, every month or more post-infection.

Generally, control subjects (e.g. animal models such as tumor-bearing animal models) are similarly monitored. Such control subjects include those that remain untreated (not infected with virus). Additional controls subjects include those infected with the parental virus preparation or mixture or with a reference virus strain, such as a known attenuated recombinant strain. Exemplary of such a strain is GLV-1 h68 or a derivative thereof containing inserted heterologous genes. In examples where subjects are infected with the parental virus preparation or mixture or other reference strain as a control, the amount of virus administered (e.g. pfu) is the same as the tested virus clonal isolate.

In some embodiments, the viruses are of a reduced toxicity such that a host typically has no significant long-term effect from the presence of the viruses in the host, beyond any effect on tumorous, metastatic or necrotic organs or tissues. For example, the reduced toxicity can be a minor fever or minor infection, which lasts for less than about a month, and following the fever or infection, the host experiences no adverse effects resultant from the fever or infection. In another example, the reduced toxicity can be measured as an unintentional decline in body weight of about 5% or less for the host after administration of the microbes. In other examples, the virus has no toxicity to the host.

For example, a virus is selected based on effects of survival of a subject compared to a control or reference strain. Viruses are selected that result in subjects having similar survival compared to subjects treated with the parental virus preparation or mixture or other reference strain (e.g. attenuated strain). In particular, a virus is selected that result in subjects having better or improved survival compared to subjects treated with the parental virus preparation or mixture or other reference strain (e.g. attenuated strain). Generally, viruses are selected that result in survival of 100% of subjects tested over the time period treated. For example, viruses are selected that result in survival of 100% of subjects at the time period at which 0% of control untreated subjects survive.

In some examples, a virus is selected based on effects on weight of a subject compared to a control or reference virus. Generally, decreased or reduced weight of a subject over the course of treatment is associated with toxicity or pathogenicity of the treatment. In some examples, viruses are selected that affect weight of a subject similar to subjects treated with the parental virus preparation or mixture or other reference strain (e.g. recombinant strain). In other examples, viruses are selected that do not result in decreased weight of a subject or result in lesser decreased weight of a subject compared to subjects treated with the parental virus preparation or mixture or other reference strain (e.g. recombinant strain). In particular, a clonal virus is selected that, over the course of treatment with the virus, results in increased weight of the subject.

5. Genome Analysis

Optionally, the clonal isolate can be purified and the genome analyzed to assess the homogeneity of sequence of the selected isolate. Generally, a clonal strain is selected that is homogenous in sequence. Various methods can be employed to confirm the identity and/or homogeneity of the virus such as, but not limited to, sequencing, restriction analysis, PCR, Southern Blot or by protein expression. For example, selected clonal isolates can be propagated in permissive cells, cells harvested, and viral particles recovered. Genomic viral DNA can be extracted using various procedures known to one of skill in the art. For Example, proteinase K followed by phenol-chloroform extraction can be used to extract DNA from purified virions (see, Earl et al., in Ausubel et al., (eds) Current protocols in molecular biology, vol. 3, pages 16.17.1-16.19-7 (1998)). Sequencing of the DNA can be completed by any method known to one of skill in the art. For example, sequencing can be done by shotgun approach followed by assembly using various software, for example, TIGR Assembler software (Sutton et al. (1995) Genome Science & Tech., 1:9-19) or the Staden software package on a Linux platform (Staden (1991) Nucleic Acids Res. 19:3907-3911; Bonfield et al. (1995) Nucleic Acids. Res., 23:4992-4999) and using various gap filling strategies (see e.g. Flint et al. (1998) DNA Seq., 8:241-245); by random priming methods (see e.g. Djikeng et al. (2008) BMC Genomics, 9:5); or by whole-genome amplification and direct sequencing techniques (Mizutani et al. (2007) Emerging Infectious Diseases, 13:322-324).

C. ISOLATED CLONAL VIRUS STRAINS

Provided herein are isolated clonal viruses of Vaccinia virus strain LIVP. The clonal strains are derived from the vaccinia virus strain LIVP.

1. LIVP

LIVP is a vaccinia strain derived from Lister (ATCC® Catalog No. VR-1549™). Vaccinia virus has a linear, double-stranded DNA genome of approximately 180,000 base pairs in length that is made up of a single continuous polynucleotide chain (Baroudy et al. (1982) *Cell*, 28:315-324). The structure is due to the presence of 10,000 base pair inverted terminal repeats (ITRs). The ITRs are involved in genome replication. Genome replication is believed to involve self-priming, leading to the formation of high molecular weight concatemers (isolated from infected cells) which are subsequently cleaved and repaired to make virus genomes. See, e.g., Traktman, P., Chapter 27, Poxvirus DNA Replication, pp. 775-798, in DNA Replication in Eukaryotic Cells, Cold Spring Harbor Laboratory Press (1996). The genome encodes for approximately 250 genes. In general, the nonsegmented, noninfectious genome is arranged such that centrally located genes are essential for virus replication (and are thus conserved), while genes near the two termini effect more peripheral functions such as host range and virulence. Vaccinia viruses practice differential gene expression by utilizing open reading frames (ORFs) arranged in sets that, as a general principle, do not overlap.

As described elsewhere herein, the LIVP strain can be obtained from the Lister Institute of Viral Preparations, Moscow, Russia; the Microorganism Collection of FSRI SRC VB Vector; or can be obtained from the Moscow Ivanovsky Institute of Virology (C0355 K0602). The parental LIVP strain has been reported to be heterogenous in sequence (see e.g. Zhang et al. (2009) Mol. Genet. Genomics, 282:417-435). A sequence of a parental genome of LIVP is set forth in SEQ ID NO:10.

Provided herein are LIVP clonal strains that exhibit improved properties over existing recombinant LIVP viruses in the absence of inserted heterologous DNA. Recombinant LIVP viruses have been generated. For example, GLV-1h68 (also named RVGL21, SEQ ID NO: 9; described in U.S. Pat. Pub. No. 2005-0031643, now U.S. Pat. Nos. 7,588,767, 7,588,771, 7,662,398) is an attenuated virus that contains DNA insertions in gene loci that are expression cassettes encoding detectable marker proteins in the F14.5L (also designated in LIVP as F3) gene locus, thymidine kinase (TK) gene locus, and hemagglutinin (HA) gene locus. Specifically, GLV-1h68 contains an expression cassette containing a Ruc-GFP cDNA molecule (a fusion of DNA encoding *Renilla* luciferase and DNA encoding GFP) under the control of a vaccinia synthetic early/late promoter $P_{SEL}$ (($P_{sEL}$)Ruc-GFP) inserted into the F14.5L gene locus; an expression cassette containing a DNA molecule encoding beta-galactosidase under the control of the vaccinia early/late promoter $P_{7.5k}$ (($P_{7.5k}$)LacZ) and DNA encoding a rat transferrin receptor positioned in the reverse orientation for transcription relative to the vaccinia synthetic early/late promoter $P_{SEL}$ (($P_{SEL}$)rTrfR) inserted into the TK gene locus (the resulting virus does not express transferrin receptor protein since the DNA molecule encoding the protein is positioned in the reverse orientation for transcription relative to the promoter in the cassette); and an expression cassette containing a DNA molecule encoding β-glucuronidase under the control of the vaccinia late promoter $P_{11k}$ (($P_{11k}$)gusA) inserted into the HA gene locus. Other recombinant LIVP viruses are derived from GLV-1h68 and contain heterologous DNA that encodes a gene product or products (see e.g. see e.g. U.S. Pub. Nos. US2003-0059400, US2003-0228261, US2009-0117034, US2009-0098529, US2009-0053244, US2009-0081639 and US2009-0136917; U.S. Pat. Nos. 7,588,767 and 7,763,420; and International Pub. No. WO 2009/139921). Exemplary of such a recombinant virus is GLV-1h64 (set forth in SEQ ID NO:326).

2. LIVP Clonal Strains

The clonal strains provided herein are derived from LIVP and have a genome that differs from the parental sequence set forth in SEQ ID NO:10. The clonal strains provided herein exhibit greater anti-tumorigenicity and/or reduced toxicity compared to the recombinant or modified virus strain designated GLV-1h68 (having a genome set forth in SEQ ID NO:9). In particular, the clonal strains provided herein are present in a virus preparation propagated from LIVP. Hence, the clonal strains do not contain non-viral heterologous nucleic acid that contains an open reading frame encoding a non-viral heterologous protein.

The clonal strains provided herein have a sequence of nucleotides that have at least 70%, such as at least 75%, 80%, 85% or 90% sequence identity to SEQ ID NO:10. For example, the clonal strains have a sequence of nucleotides that has at least 91%, 92%, 93%, 94%, 95%, 95%, 97%, 98%, 99%, 99.1%, 99.2%, 99.3%, 99.4%, 99.5%, 99.6%, 99.7%, 99.8%, 99.9%, but are less than 100% identical SEQ ID NO:10. Such LIVP clonal viruses provided herein include viruses that differ in one or more open reading frames (ORF) compared to the parental LIVP strain that has a sequence of nucleotides set forth in SEQ ID NO:10. For example, LIVP clonal viruses provided herein include viruses that differ in one or more ORF compared to the parental LIVP strain that has a sequence of amino acids set forth in SEQ ID NO:10. The LIVP clonal virus strains provided herein can contain a nucleotide deletion or mutation in any one or more nucleotides in any ORF compared to SEQ ID NO:10, or can contain an addition or insertion of viral DNA compared to SEQ ID NO:10. For example, LIVP clonal virus strains provided herein can contain a nucleotide deletion, mutation or addition (i.e. insertion) of one or more nucleotides in ORFs designated gl001/290, gl009/283, gl010/282, gl011/280, gl015, gl032, gl034, gl035, gl037, gl069, gl077, gl079, gl082, gl084, gl088, gl093, gl225, gl230, gl239, gl241, gl257, gl264, gl270, gl273, gl274, gl277/105, gl280/011, gl282/010, gl283/009 compared to SEQ ID NO:10. In one example, LIVP clonal virus strains are provided having an ORF that encodes a truncated protein. In other examples, provided herein are LIVP clonal virus strains that contain insertions, deletions or mutations in the promoter region of an ORF. In particular examples, the insertion, deletion or mutation of one or more nucleotides in the ORF results in the production of a non-functional protein (e.g. not active) or eliminates the production of the protein by the virus.

LIVP clonal strains provided herein do not include modified or recombinant virus strains that are modified to include heterologous nucleic acid that contains an open reading frame encoding a heterologous protein. For example, an LIVP clonal strain provided herein does not include a sequence of nucleotides contained in the recombinant virus designated GLV-1h68 (set forth in SEQ ID NO:9) or other recombinant virus strains derived therefrom, such as the virus designated GLV-164 (set forth in SEQ ID NO:326) or a virus designated GLV-1i69 (set forth in SEQ ID NO:3). In one example, the clonal trains provided herein exhibit improved or better anti-tumorigenicity compared to LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9. In particular examples, the clonal strains provided herein exhibit similar anti-tumorigenicity or less tumorigenicity (i.e. improved or better anti-tumorigenicity) compared to the recombinant LIVP strain GLV-1h68 having a sequence of nucleotides set forth in SEQ ID NO:9. For example, LIVP clonal strains provided herein exhibit improved or better anti-tumorigenic activity compared to LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9, such as at or between 120% to 1000%, for example, at least 120%, 130%, 140%, 150%, 160%, 170%, 180%, 190%, 200%, 250%, 300%, 400%, 500%, 1000% or more of the anti-tumorigenic activity. The anti-tumorigenicity can be determined using any of the in vitro or in vivo tests for parameters indicative of anti-tumorigenicity as described above in Section B. For example, compared to the LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9, the LIVP clonal strains provided herein exhibit increased cytotoxicity of tumor cells in in vitro or in vivo assays or models; decreased tumor growth or increased tumor shrinkage in in vitro or in vivo assays or models; decreased tumor volume, size or weight in in vitro or in vivo assays or models; increased replication or accumulation in tumor cells in in vitro or in vivo assays or models; and increased expression of viral genes, tumor proteins and/or housekeeping genes correlated with viral replication and/or infectivity in tumor cells in in vitro or in vivo assays or models.

In another example, the clonal strains provided herein are less toxic (i.e. less virulent) compared to LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9. In other examples, the clonal strains provided herein exhibit similar toxicity or less toxicity compared to the recombinant LIVP strain GLV-1h68 having a sequence of nucleotides set forth in SEQ ID NO:9. Parameters indicative of toxicity or virulence include, but are not limited to, reduced or decreased survival rate of the subject, decrease in body weight, existence of side effects such as fever, rash or other allergy, fatigue or abdominal pain, induction of an immune response in the subject, tissue distribution of the virus, amount of tumor antigens that are released and decreased rate of pock formation. The toxicity or virulence can be determined using any of the in vitro or in vivo tests described above in Section B. LIVP clonal strains provided herein exhibit at or between 0% to 99%, for example, less than 99%, 98%, 97%, 96%, 95%, 90%, 80%, 70%, 60%, 50%, 40%, 30%, 20%, 10%, 5% or less of the toxicity of compared to LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9. In other examples, LIVP clonal strains provided herein exhibit at or between 70% to 120%, for example, at least or about 70%, 80%, 90%, 95%, 100%, 110%, 115% or 120% of the toxicity or anti-tumorigenic activity compared to LIVP strain GLV-1h68 having a sequence of nucleotides set forth in SEQ ID NO:9 in an assay or method to assess a parameter indicative of toxicity.

In particular examples, clonal strains provided herein are less toxic (i.e. less virulent) and exhibit improved anti-tumorigenicity compared to LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9. For example, clonal strains provided herein are less toxic and exhibit improved or greater anti-tumorigenicity compared to the recombinant LIVP strain designated GLV-1h68 (SEQ ID NO:9).

For example, the clonal strains are less toxic (i.e. less virulent) when administered to a subject in an amount effective to induce anti-tumorigenic activity. Such amounts can be empirically determined by a person skilled in the art and are dependent on a variety of factors such as the particular subject, the disease or condition being treated, the type of tumor or cancer, the stage or progression of the disease and other similar factors. For treatment of a mouse or other similarly sized subject, exemplary therapeutic amounts of a clonal strain are in the range of about or between $1\times10^4$ to $1\times10^8$ pfu, such as $1\times10^5$ to $1\times10^7$ pfu, for example at least or about or $1\times10^4$, $1\times10^5$, $1\times10^6$, $2\times10^6$, $3\times10^6$, $4\times10^6$ or $5\times10^6$ pfu. For treatment of a human subject or other similarly sized subject, exemplary therapeutic amounts of a clonal strain are in the range of about or between $1\times10^7$ to $1\times10^{14}$ pfu, $1\times10^7$ to $1\times10^{10}$ pfu, such as $1\times10^9$ to $1\times10^{10}$ pfu, for example at least or about $1\times10^7$, $1\times10^8$, $1\times10^9$, $2\times10^9$, $3\times10^9$, $4\times10^9$, or $5\times10^9$ pfu. Dosage regimes can vary as described elsewhere herein. In particular, LIVP clonal strains provided herein over the course of a treatment regime, exhibit 100% survival of subjects and are not associated with effecting decreased or reduced weight of a subject over the course of treatment. In one example, clonal strains provided herein, when administered to a subject, exhibit a survival rate that is increased compared to the survival rate of subjects administered with the same or similar therapeutic amount an LIVP strain obtained from the Lister Institute of Viral Preparations, Moscow, Russia, the LIVP strain having a sequence of nucleotides set forth in SEQ ID NO:10 and/or the recombinant LIVP strain designated GLV-1h68 having a sequence of nucleotides set forth in SEQ ID NO:9.

Isolated LIVP clonal viruses provided herein can be derived from plaque isolation of LIVP that is propagated through repeat passage in cells lines. For example, LIVP clonal isolates can be obtained by passage of virus in embryonated chicken eggs culture, in chicken embryo fibroblasts (CEF), HeLA S3 cells, CV-1 cells or BHK-21 cells. The LIVP clonal isolates provided herein are homogenous in sequence. Exemplary of LIVP clonal viruses provided herein are clonal isolates selected in the method herein that exhibit anti-tumorigenic properties and reduced toxicity.

Exemplary LIVP Clonal Strains

LIVP clonal strains provided herein include those that have a nucleotide sequence corresponding to nucleotides 10,073-180,095 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7 or nucleotides 6,899-181,870 of SEQ ID NO:8, or to a complement thereof. LIVP clonal strains provided herein generally also include terminal nucleotides corresponding to a left and/or right inverted terminal repeat (ITR). Exemplary LIVP clonal strains provided herein include those that have a nucleotide sequence set forth in SEQ ID NOS: 1, 2, 4, 5, 6, 7 or 8, or to a complement thereof, or that exhibit similar toxicity and anti-tumorigenicity to a clonal strain that has a nucleotide sequence set forth in SEQ ID NOS: 1, 2, 4, 5, 6, 7 or 8.

The LIVP clonal strains provided herein also include variants of any of these viruses, which have sequences that are similar to, but not identical to, those of a virus that has a nucleotide sequence set forth in SEQ ID NOS: 1, 2, 4, 5, 6, 7 or 8. In particular, variant viruses can include nucleotide sequences that are, for example, at least 97%, 98%, or 99% or more identical, such as at least 99% identical to the sequences of nucleotides set forth in SEQ ID NOS: 1, 2, 4, 5, 6, 7 or 8, or to a complement thereof. For example, variant viruses can include nucleotide sequences that are, for example, at least 99.1%, 99.2%, 99.3%, 99.4%, 99.5%, 99.7%, 99.8%, 99.9%, 99.95%, 99.99%, 99.995% or 99.999% or more identical to the sequences of nucleotides set forth in SEQ ID NOS: 1, 2, 4, 5, 6, 7 or 8, or to a complement thereof. The variant clonal strains exhibit similar toxicity and anti-tumorigenicity to a clonal strain that has a nucleotide sequence set forth in SEQ ID NOS: 1, 2, 4, 5, 6, 7 or 8.

Exemplary clonal strains of LIVP provided herein are LIVP 1.1.1, LIVP 2.1.1, LIVP 4.1.1, LIVP 5.1.1, LIVP 6.1.1, LIVP 7.1.1 or LIVP 8.1.1 or clonal strains that exhibit similar toxicity and anti-tumorigenicity as any of the clonal strains LIVP 1.1.1, LIVP 2.1.1, LIVP 4.1.1, LIVP 5.1.1, LIVP 6.1.1, LIVP 7.1.1 or LIVP 8.1.1. The clonal strains or preparations thereof can be isolated from cultured cells in which parental LIVP, LIVP 1.1.1, LIVP 2.1.1, LIVP 4.1.1, LIVP 5.1.1, LIVP 6.1.1, LIVP 7.1.1 or LIVP 8.1.1, or a variant thereof, has been cultured. For example, the clonal strains or preparations thereof can be obtained by isolating LIVP clones from cell cultures in which parental LIVP, LIVP 1.1.1, LIVP 2.1.1, LIVP 4.1.1, LIVP 5.1.1, LIVP 6.1.1, LIVP 7.1.1 or LIVP 8.1.1, or a variant thereof, has been propogated. In some examples, the clonal strains are isolated from a virus mixture by the method described herein above to identify clonal strains that exhibit improved anti-tumorigenicity and minimal toxicity compared to a parental virus preparation or mixture or other reference strain. Exemplary isolated clonal LIVP virus strains provided herein include an isolated clonal LIVP virus strain selected from the LIVP mixture produced by adaptation of the Lister strain onto calf skin (LIVP produced by the Lister Institute of Viral preparations, Moscow, Russia).

D. MODIFICATION OF LIVP STRAINS

Provided herein are modified LIVP virus strains that are modified in their genomic sequence. The linear dsDNA viral genome of vaccinia virus is approximately 200 kb in size, encoding a total of approximately 250 genes. The vaccinia virus genome has a large carrying capacity for foreign genes, where up to 25 kb of exogenous DNA fragments (approximately 12% of the vaccinia genome size) can be inserted. The genomes of several of the vaccinia strains have been completely sequenced, and many essential and nonessential genes identified. Due to high sequence homology among different strains, genomic information from one vaccinia strain can be used for designing and generating modified viruses in other strains. Finally, the techniques for production of modified vaccinia strains by genetic engineering are well established (Moss, *Curr. Opin. Genet. Dev.* 3: 86-90 (1993); Broder and Earl, *Mol. Biotechnol.* 13: 223-245 (1999); Timiryasova et al., *Biotechniques* 31: 534-540 (2001)).

For example, provided herein is a LIVP virus that is modified in a genomic sequence compared to the genomic sequence set forth in SEQ ID NO:1 (LIVP 1.1.1), SEQ ID NO:2 (LIVP 2.1.1), SEQ ID NO:4 (LIVP 4.1.1), SEQ ID NO:5 (LIVP 5.1.1), SEQ ID NO:6 (LIVP 6.1.1), SEQ ID NO:7 (LIVP 7.1.1), SEQ ID NO:8 (LIVP 8.1.1) or SEQ ID NO:9 (GLV1h68). Modifications can include any change to the genome of the virus, such as mutation, insertion, deletion, or substitution (replacement) of nucleic acid or other modification of the genomic sequence of the virus. For example, viruses provided herein can be modified to contain one or more heterologous nucleic acid molecule inserted or replaced into the genome of the virus. In one example, modifications can include insertion or replacement of one or more nucleotides, such as at least 1, 2, 3, 4, 5, 6, 7, 8, 9, 10, 20, 30, 40, 50, 60, 70, 80, 90, 100, 150, 200, 250, 300, 350, 400, 450, 500 or more nucleotides.

A heterologous nucleic acid molecule can contain an open reading frame or can be a non-coding sequence. In some cases, the heterologous nucleic acid replaces all or a portion of a viral gene. The viral gene can be replaced with a homologous gene from another virus or a different gene. In other examples the viruses provided herein can be modified by insertion of one or more heterologous nucleic acid molecules. For example, 1, 2, 3, 4, 5, 6, 7, 8, 9, 10 or more heterologous nucleic acid molecules can be inserted. Generally, the heterologous nucleic acid that is inserted is a contiguous sequence of nucleotides that contains an open reading frame and corresponds to a coding region of a gene. For example, a heterologous nucleic acid molecule can be inserted that encodes a heterologous gene. Generally, the heterologous gene is a gene that encodes a non-viral protein. Inserted or replaced genes can be transcribed and/or translated from the viral genome following infection of a host cell, such as a tumor cell. As described below, the heterologous nucleic acid can contain a regulatory sequence to control expression of the gene. For example, the heterologous nucleic acid can be operably linked to a promoter for expression of an open reading frame.

Modifications of the viruses provided herein can result in a modification of virus characteristics or properties, including those associated with parameters indicative of toxicity or anti-tumorigenicity. Exemplary insertions, mutations or deletions are those that result in an attenuated vaccinia virus relative to the clonal strain not containing the modification. For example, insertions, mutations or deletions can decrease pathogenicity of the clonal strain, for example, by reducing the toxicity, reducing the infectivity, reducing the ability to replicate or reducing the number of non-tumor organs or tissues to which the vaccinia virus can accumulate. Other exemplary insertions, mutations or deletions include, but are not limited to, those that increase antigenicity of the virus, those that permit detection or imaging, those that alter attenuation of the virus, and those that alter infectivity. Modifications can be made, for example, in genes that are involved in nucleotide metabolism, host interactions and virus formation.

For example, the modified clonal strains provided herein can exhibit reduced toxicity or pathogenicity compared to the clonal strain not containing the modification. In another example, the modified clonal strains provided herein can exhibit improved anti-tumorigenicity compared to the clonal strain not containing the modification. For example, modified clonal strains can exhibit improved ability to preferentially accumulate in tumor, ability to lyse cells or cause cell death, ability to elicit an immune response against rumor cells, immumnogenicity and replication competence. In other examples, modified clonal strains exhibit reduced toxicity and increased anti-tumorigenicity.

In other examples, modifications can made by insertion of heterologous nucleic acid molecules that encode a gene for expression of a protein and/or expression of an RNA molecule. The one or more heterologous nucleic acid molecules can encode, for example, a therapeutic gene product; a detectable gene product or a gene product capable of inducing a detectable signal, such as a gene product that can be used for diagnosis, monitoring or imaging; an antigen (e.g. a superantigen), such as an antigen for tumor therapy. Any of the heterologous genes expressed by a virus provided herein can be made for the purpose of harvesting the expressed gene product.

1. Heterologous Nucleic Acid

The large genome size of poxviruses, such as the viruses provided herein, allows large inserts of heterologous DNA and/or multiple inserts of heterologous DNA to be incorporated into the genome (Smith and Moss (1983) Gene 25(1): 21-28). The viruses provided herein, for example any clonal strain provided herein, can be modified by insertion of 1, 2, 3, 4, 5, 6, 7, 8, 9, 10 or more heterologous DNA molecules. Generally, the one or more heterologous DNA molecules are inserted into a non-essential region of the virus genome. For example, the one or more heterologous DNA molecules are inserted into a locus of the virus genome that is non-essential for replication in proliferating cells, such as tumor cells. Exemplary insertion sites are provided herein below and are known in the art.

In some examples, the virus can be modified to express an exogenous or heterologous gene. Exemplary exogenous gene products include proteins and RNA molecules. The modified viruses can express a therapeutic gene product, a detectable gene product, a gene product for manufacturing or harvesting, an antigenic gene product for antibody harvesting, or a viral gene product. The characteristics of such gene products are described herein and elsewhere.

In some examples, the viruses can be modified to express two or more gene products, such as 2, 3, 4, 5, 6, 7, 8, 9, 10 or more gene products, where any combination of the two or more gene products can be one or more detectable gene products, therapeutic gene products, gene products for manufacturing or harvesting or antigenic gene products for antibody harvesting or a viral gene product. In one example, a virus can be modified to express an anticancer gene product. In another example, a virus can be modified to express two or more gene products for detection or two or more therapeutic gene products. In some examples, one or more proteins involved in biosynthesis of a luciferase substrate can be expressed along with luciferase. When two or more exogenous genes are introduced, the genes can be regulated under the same or different regulatory sequences, and the genes can be inserted in the same or different regions of the viral genome, in a single or a plurality of genetic manipulation steps. In some examples, one gene, such as a gene encoding a detectable gene product, can be under the control of a constitutive promoter, while a second gene, such as a gene encoding a therapeutic gene product, can be under the control of an inducible promoter. Methods for inserting two or more genes in to a virus are known in the art and can be readily performed for a wide variety of viruses using a wide variety of exogenous genes, regulatory sequences, and/or other nucleic acid sequences.

In particular, the viruses provided herein can be modified for expressing genes in vivo and in vitro. In some examples, the viruses can express heterologous genes that are secreted from the host cell. In some examples, the viruses can express heterologous genes that are released from the host cell upon cell death, lysis or leakage from the cell membrane during infection. In some examples, the viruses can express heterologous genes at levels high enough that permit harvesting products of the heterologous gene from the tumor or other patient biological sample, such as the blood or lymph sample. In some examples, the virus can express a tumor antigen for the induction of an immune response in a subject. In such examples, antibodies against the antigen can be harvested.

For example, exemplary genes include list of genes including the list of human genes and genetic disorders authored and edited by Dr. Victor A. McKusick and his colleagues at Johns Hopkins University and elsewhere, and developed for the World Wide Web by NCBI, the National Center for Biotechnology Information; online, Mendelian Inheritance in Man, OMIM™ Center for Medical Genetics, Johns Hopkins University (Baltimore, Md.), and National Center for Biotechnology Information, National Library of Medicine (Bethesda, Md.), 1999; and those available in public databases, such as PubMed and GenBank (see, e.g., (ncbi.nim.nih.gov/entrez/query.fcgi?db=OMIM). These genes include, but are not limited to: 239f2h9, 3pk, 4ebp1, 4ebp2, al1, al2 m1, al2m2, al2 m3, al2m4, al5, a1b, a1bg, a1st, a2m, a2mr, a2mrap, aa, aaa, aaa, aabt, aac1, aac2, aact, aadac, aanat, aars, aas, aat, aays1, abc1, abc2, abc3, abc7, abc8, abcr, abi1, abl1, abl2, abl1, abo, abp, abp1, abpa, abpx, abr, acaa, acac, acaca, acacb, acad1, acadm, acads, acadsb, acadv1, acat, acat1, acat2, acc, accb, accn1, accn2, accpn, ace1, ach, ache, achm1, achm2, achrd, achrg, ac1s, acly, aco1, aco2, acox, acox1, acox2, acox3, acp1, acp2, acp5, acpp, acr, acrv1, acs3, acs3, acs4, act2, act35, acta1, acta2, acta3, actb, actc, actg1, actg2, actl1, actn1, actn2, actn3, actsa, acug, acvr1, acvr2b, acvrl1, acvrlk1, acvrlk2, acvrlk3, acy1, ad1, ad2, ad3, ad4, ad5, ada, adam10, adam11, adam12, adam3, adam3a, adam3b, adam8, adar, adarb1, adarb2, adcp1, adcp2, adcy1, adcy2, adcy3, adcy3, adcy4, adcy5, adcy6, adcy7, adcy8, adcy9, adcyap1, adcyaplr1, add1, add2, add3, addl, adfn, adh1, adh2, adh3, adh4, adh5, adh7, adhaps, adhc1@, adhr, adhr, adk, ad1, adm, admix, adora1, adora2a, adora2b, adora21, adora21, adora3, adprt, adra1a, adra1b, adra1c, adra1d, adra2a, adra2b, adra2c, adra2l1, adra2l2, adra2r, adrb1, adrb1r, adrb2, adrb2rl1, adrb3, adrbk1, adrbk2, ads1, adss, adtb1, adx, adxr, ae1, ae2, ae3, aegl1, aemk, aes, af10, af17, af4, af6, af8t, af9, afd1, afdn, afg3, afg311, afm, afp, afx1, aga, agc1, ager, ag1, agmx1, agmx2, agp1, agp7, agps, agrn, agrp, agrt, ags, agt, agti1, agtr1, agtr1a, agtr2, agtr11, agxt, ahc, ahcy, and, ands, ahnak, aho2, ahr, ahsg, ahx, aib1, aic, aic1, aied, aih1, aih2, aih3, aim1, air, airc, aire, ak1, ak2, ak3, akap149, akt1, akt2, aku, alad, alas1, alas2, alb, alb2, alba, alcam, ald, aldh1, aldh10, aldh2, aldh3, aldh4, aldh5, aldh6, aldh9, ald11, aldoa, aldob, aldoc, aldr1, aids, alk, alk1, alk2, alk3, alk6, alms1, alox12, alox15, alox5, alp, alpi, alp1, alpp, alpp12, alr, alr, als1, als2, als4, als5, alss, ambn, ambp, amcd1, amcd2b, amcn, amcn1, amcx1, amd1, amdm, amelx, amely, amfr, amg, amg1, amgx, amh, amhr, amhr2, am11, am11t1, am12, am13, amog, ampd1, ampd2, ampd3, amph, amph1, ampk, amt, amy1a, amy1b, amy1c, amy2a, amy2b, an2, anc, ancr, ang, ang1, anh1, ank1, ank2, ank3, anop1, anova, anp, anpep, anpra, anprb, anprc, ans, ant1, ant2, ant3, ant3y, anx1, anx11, anx13, anx2, anx214, anx3, anx4, anx5, anx6, anx7, anx8, aoah, aoc2, aox1, ap2tf, apah1, apba1, apba2, apbb1, apbb2, ape, apes, ape, apeced, apeh, apex, api1, api2, api3, apj, aplp, aplp1, aplp2, apnh, apo31, apoa1, apoa2, apoa4, apob, apobec1, apoc1, apoc2, apoc3, apoc4, apod, apoe, apoer2, apoh, apolmt, apolp1@, apolp2@, app, appbp1, appl1, aprf, aprt, aps, apt1, aptl1g1, apx1, apy, aqdq, aqp0, aqp1, aqp2, aqp21, aqp3, aqp4, aqp5, aqp6, aqp7, ar, ar1, ara, araf1, araf2, arcn1, ard1, ard1, areg, arf1, arf2, arf3, arf41, arf5, arg, arg1, args, arh12, arh6, arh9, arha, arhb, arhc, arhg, arhgap2, arhgap3, arhgap6, arhgdia, arhgdib, arhh, arix, arl2, armd1, arnt, arnt1, aro, arp, arp1, arpkd, arr3, arrb1, arrb2, arsa, arsacs, arsb, arsc1, arsc2, arsd, arse, arsf, art, art1, art3, art4, arts, arvd1, arvd2, arvd3, arvd4, as, asat, asb, ascl1, ascl2, arct1, asd1, asd2, asgr1, asgr2, ash1, asip, as1, as1n, asm1, asma, asmd, asmt, asmtlx, asmty, asnrs, asns, aspa, ass, astm1, astn, asv, at, at1, at2r1, at3, ata, atbf1, atcay, atf1, ath1, aths, atm, atoh1, atox1, atp1a1, atp1a2, atp1a3, atp1a11, atp1b1, atp1b2, atp1b3, atp1b11, atp1g1, atp2a1, atp2a2, atp1a3, atp2b, atp2b1, atp2b2, atp2b2, atp2b3, atp2b4, atp4a, atp4b, atp5, atp5a, atp5b, atp5g1, atp5g2, atp5g3, atp5o, atp6a, atp6b1, atp6c, atp6e, atp6n1, atp7a, atp7b, atpm, atpsb, atpsk1, atpsk2, atq1, atr, atr, atr1, atr1, atr2, atrc1, atrc2, atrx, ats, atsv, atx1, atx2, au, auf1, auf1a, aut, avcd, aved, avp, avpr1a, avpr1b, avpr2, avpr3, avrp, aysd, awa1, ax1, axl1g, axsf, azf1, azf2, azgp1, azu1, b120, b144, blg1, b29, b2m, b2mr, b3galt4, b4galt1, ba2r, bab1, bag1, bai1, bai2, bai3, bak1, bam22, bap1, bap135, bapx1, bard1, bark2, bas, bat1, bat2, bat3, bat4, bat5, bax, bb1, bbbg1, bbbg2, bbs1, bbs2, bbs3, bbs4, bbs5, bcas1, bcat1, bcat2, bcate2, bcd1, bcei, bche, bckdha, bckdhb, bcl1, bcl10, bcl2, bcl2a1, bcl212, bcl3, bcl5, bcl6, bcl7, bcl7a, bcl8, bcl9, bclw, bcm, bcm1, bcma, bcns, bcns, bcp, bcpm, bcpr, bcr, bcrl2, bcrl3, bcrl4, bcsg1, bct1, bct2, bdb, bdb1, bdc, bde, bdkrb1, bdkrb2, bdmf, bdmr, bdnf, bed, bedp, bek, bene, bevi, bf, bf1, bf2, bfhd, hfic, bfls, bfnc2, bfp, bfsp1, bft, bglap, bgmr, bgn, bgp, bhd, bhpcdh, bhr1, bicd1, bid, bigh3, bin1, bir, bjs, bkma1, blast1, blau, blk, blm, blmh, bltr, blvra, blvrb, blym, bmal1, bmd, bmh, bmi1, bmp1, bmp2, bmp2a, bmp2b1, bmp3, bmp4, bmp5, bmp6, bmp7, bmp8, bmpr1a, bmpr1b, bmx, bmyb, bn51t, bnc, bnc1, bnp, bori, bpad, bpag1, bpag2, bpes, bpes1, bpes2, bpgm, bph1, bpi, br, br140, braf, brca1, brca2, brca3, brca-cox, brcd1, brcd2, brdt, brf1, brhc, bric, brks, brn3a, brn3b, brn3c, brrn1, brw1c, bs, bsap, bsep, bsf2, bsg, bsnd, bss1, bst1, bst2, btak, btc, btd, bteb, bteb1, btg1, btg2, bths, btk, btk1, btn, bts, bub1b, bubr1, bwr1a, bwr1b, bws, bwscr1a, bwscr1b, bzrp, bzx, c11orf13, c1nh, c1qa, c1qb, c1qbp, c1qg, c1r, c1s, c2, c21orf1, c21orf2, c21orf3, c2ta, c3, c3br, c3dr, c3g, c4a, c4b, c4 bpa, c4 bpb, c4f, c4s, c5, c5ar, c5r1, c6, c7, c8a, c8b, c8g, c9, ca1, ca12, ca125, ca2, ca21h, ca3, ca4, ca5, ca6, ca7, ca8, ca9, caaf1, cabp9k, cac, cac@, caca, cacd, cacna1a, cacna1b, cacna1c, cacna1d, cacna1e, cacna1f, cacna1s, cacna2, cacnb1, cacnb2, cacnb3, cacnb4, cacng, cacnl1a1, cacnl1a2, cacnl1a3, cacnl1a4, cacnl1a5, cacnl1a6, cacnl2a, cacnlb1, cacnlg, cacp, cact, cacy, cad, cad11, cadasi1, cae1, cae3, caf, caf1a, caga, cagb, cain, cak, cak1, cal11, calb1, calb2, calb3, calc1, calc2, calca, calcb, calcr, cald1, calla, calm1, calm2, calm3, calm11, calm13, calna, calna3, calnb, calnb1, calr, cals, calt, calu, cam, camk4, camkg, caml1, camlg, camp, can, canp3, canx, cap2, cap3, cap37, capb, capg, cap1, capn1, capn2, capn3, capn4, cappa2, cappb, capr, caps, capza2, capzb, car, carp, cars, cart1, cas, cas2, casi1, casp1, casp10, casp2, casp3, casp3, casp4, casp5, casp6, casp7, casp8, casq1, casq2, casr cast, cat, cat1, cat4, catf1, catm, cav1, cav2, cav3, cbbm, cbd, cbfa1, cbfa2, cbfa2t1, cbfa3, cbfb, cbg, cb1, cbl2, cbln2, cbp, cbp, cbp2, cbp68, cbr1, cbs, cbt, cbt1, cc10, cca, cca1, cca11, cca12, ccb11, ccckr5, ccg1, ccg2, cch1la1, cch1la2, cch1la3, cch1b1, cck, cckar, cckbr, cc1, ccm1, ccm2, ccm3, ccn1, ccna, ccnb1, ccnc, ccnd1, ccnd2, ccnd3, ccne, ccnf, ccng1, ccnh, ccnt, ccnt1, cco, ccr10, ccr2, ccr3, ccr9, ccsp, cct, ccv, cczs, cd, cd10, cd11a, cd11b, cd11c, cd13, cd137, cd14, cd15, cd151, cd156, cd16, cd164, cd18, cd19, cd1a, cd1b, cd1c, cd1d, cd1e, cd2, cd20, cd22, cd23, cd24, cd26, cd27, cd271, cd28, cd281g, cd281g2, cd30, cd32, cd33, cd34, cd36, cd3611, cd3612, cd37, cd38, cd39, cd3911, cd3d, cd3e, cd3g, cd3z, cd4, cd40, cd401g, cd41b, cd43, cd44, cd45, cd46, cd47, cd48, cd49b, cd49d, cd5, cd53, cd57, cd58, cd59, cd51, cd6, cd63, cd64, cd68, cd69, cd7, cd70, cd71, cd72, cd74, cd79a, cd79b, cd80, cd81, cd82, cd82, cd86, cd8a, cd8b, cd8b1, cd9, cd94, cd95, cd97, cd99, cda, cda1, cda3, cdan1, cdan2, cdan3, cdb2, cdc2, cdc20, cdc25a, cdc25b, cdc25c, cdc27, cdc211, cdc212, cdc214, cdc34, cdc42, cdc51, cdc7, cdc711, cdcd1, cdcd2, cdcd3, cdc11, cdcre1, cdg1, cdgd1, cdgg1 cdgs2, cdh1, cdh11, cdh12, cdh13, cdh14, cdh15, cdh16, cdh16, cdh17, cd2, cdh3, cdh3, cdh5, cdh7, cdh8, cdhb, cdhh, cdhp, cdhs, cdk2, cdk3, cdk4, cdk5, cdk7, cdk8, cdk9, cdkn1, cdkn1a, cdkn1b, cdkn1c, cdkn2a, cdkn2b, cdkn2d, cdkn3, cdkn4, cdl1, cdm, cdmp1, cdmt, cdpx1, cdpx2, cdpxr, cdr1, cdr2, cdr3, cdr62a, cdsn, cdsp, cdtb, cdw50, cdx1, cdx2, cdx3, cdx4, cea, cebp, cebpa, cebpb, cebpd, cebpe, cecr, ce1, cel1, cen1, cenpa, cenpb, cenpc, cenpc1, cenpe, cenpf, cerd4, ces, ces1, cetn1, cetp, cf, cf2r, cfag, cfag, cfc, cfd1, cfeom1, cfeom2, cfh, cfl1, cfl2, cfnd, cfns, cftr, cg1, cga, cgat, cgb, cgd, cgf1, cgh, cgrp, cgs23, cgt, cgthba, chac, chat, chc1, chd1, chd2, chd3, chd4, chd5, chdr, che1, che2, ched, chek1, chga, chgb, chgc, chh, chi311, chip28, chit, chk1, chlr1, chlr2, chm, chm1, chn, chn1, chn2, chop10, chr, chr39a, chr39b, chr39c, chrm1, chrm2, chrm3, chrm4, chrm5, chrna1, chrna2, chrna3, chrna4, chma5, chrna7, chmb1, chrnb2, chrnb3, chrnb4, chrnd, chrne, chrng, chrs, chs1, chx10, ciipx, cip1, cirbp, cish, ck2a1, ckap1, ckb, ckbb, ckbe, ckm, ckmm, ckmt1, ckmt2, ckn1, ckn2, ckr3, ckr11, ckr13, c1, cl100, cla1, cla1, clac, clapb1, clapm1, claps3, clc, clc7, clck2, clcn1, clcn2, clcn3, clcn4, clcn5, clcn6, clcn7, clcnka, clcnkb, cld, cldn3, cldn5, clg, clg1, clg3, clg4a, clg4b, cli, clim1, clim2, clk2, clk3, cln1, cln2, cln3, cln5, cln6, cln80, clns1a, clns1b, clp, clpp, clps, clta, cltb, clte, clte11, cltd, clth, clu, cma1, cmah, cmar, cmd1, cmd1a, cmd1b, cmd1c, cmd1d, cmd1e, cmd1f, cmd3a, cmdj, cmh1, cmh2, cmh3, cmh4, cmh6, cmkbr1, cmkbr2, cmkbr3, cmkbr5, cmkbr6, cmkbr7, cmkbr8, cmkbr9, cmkbrl2, cmkbrl, cmkr11, cmkr12, cml, cmm, cmm2, cmoat, cmp, cmpd1, cmpd2, cmpd2, cmpd3, cmpx1, cmt1a, cmt1b, cmt2a, cmt2b, cmt2d, cmt2d, cmt4a, cmt4b, cmtnd, cmtx1, cmtx2, cna1, cna2, cnbp1, cnc, cncg1, cncg2, cncg31, cnd, cng3, cnga1, cnga3, cngb1, cnn1, cnn2, cnn3, cnp, cnr1, cnsn, cntf, cntfr, cntn1, co, coca1, coca2, coch, cod1, cod2, coh1, coil, col10a1, col11a1, col11a2, col12a11, col13a1, col15a1, col16a1, col17a1, col18a1, col19a1, col1a1, col1a2, col1ar, col2a1, col3a1, col4a1, col4a2, col4a3, col4a4, col4a5, col4a6, col5a1, col5a2, col6a1, col6a2, col6a3, col7a1, col8a1, col8a2, col9a1, col9a1, col9a2, col9a3, colq, comp, comt, copeb, copt1, copt2, cord1, cord2, cord5, cord6, cort, cot, cox10, cox4, cox5b, cox6a1, cox6b, cox7a1, cox7a2, cox7a3, cox7am, cox8, cp, cp107, cp115, cp20, cp47, cp49, cpa1, cpa3, cpb2, cpb2, cpd, cpe, cpetr2, cpm, cpn, cpn1, cpn2, cpo, cpp, cpp32, cpp32, cppi, cps1, cpsb, cpsd, cpt1a, cpt1b, cpt2, cpu, cpx, cpx, cpxd, cr1, cr2, cr3a, crabp1, crabp2, crapb, crarf, crat, crbp1, crbp2, crd, crd1, creb1, creb2, crebbp, creb11, crem, crfb4, crfr2, crh, crhbp, crhr, crhr1, crhr2, crip, crk, crk1, crm1, crmp1, crmp2, crp, crp1, crs, crs1c, crs2, crs3, crsa, crt, crtl1, crtm, crx, cry1, cry2, crya1, crya2, cryaa, cryab, cryb1, cryb2, cryb3, cryba1, cryba2, cryba4, crybb1, crybb2, crybb3, cryg1, cryg2, cryg3, cryg4, cryg8, cryg@, cryga, crygb, crygc, crygd, crygs, crym, cryz, cs, csa, csb, csbp1, csci, csd, csd2, csda, cse, cse11, csf1, csf1r, csf2, csf2ra, csf2rb, csf2ry, csf3, csf3r, csh1, csh2, csk, csmf, csn1, csn10, csn2, csn3, csnb1, csnb2, csnb3, csnk1a1, csnk1d, csnk1e, csnk1g2, csnk2a1, csnk2a2, csnk2b, csnu3, cso, cspb, cspg1, cspg2, cspg3, csr, csrb, csrp, csrp1, csrp2, cst1, cst1, cst2, cst3, cst4, cst4, cst5, cst6, csta, cstb, csx, ct2, ctaa1, ctaa2, ctag, ctb, ctbp1, ctbp2, ctgf, cth, cthm, ctk, ctla1, ctla3, ctla4, ctla8, ctm, ctnna1, ctnna2, ctnnb1, ctnnd, ctnnd1, ctnr, ctns, ctp, ctpct, ctps, ctr1, ctr2, ctrb1, ctrl, ctsa, ctsb, ctsc, ctsd, ctse, ctsg, ctsg12, ctsh, ctsk, cts1, ctss, ctsw, ctsz, ctx, cubn, cul3, cul4b, cul5, cutl1, cvap, cvd1, cvl, cx26, cx31, cx32, cx37, cx40, cx43, cx46, cx50, cxb3s, cxcr4, cxorf4, cyb5, cyb561, cyba, cybb, cyc1, cyk4, cyld1, cymp, cyp1, cyp11a, cyp11b1, cyp11b2, cyp17, cyp19, cyp1a1, cyp1a2, cyp1b1, cyp21, cyp24, cyp27, cyp27a1, cyp27b1, cyp2a, cyp2a3, cyp2a6, cyp2b, cyp2c, cyp2c19, cyp2c9, cyp2d, cyp2d@, cyp2e, cyp2e1, cyp2f1, cyp2j2, cyp3a4, cyp4a11, cyp4b1, cyp51, cyp7, cyp7a1, cyr61, cyrn1, cyrn2, czp3, d10s105e, d10s170, d10s170, d11s302e, d11s636, d11s813e, d11s833e, d12s2489e, d12s53e, d13s1056e, d13s25, d14s46e, d15s12, d15s226e, d15s227e, d16s2531e, d16s469e, d17s136e, d17s811e, d18s892e, d19s204, d19s381e, d1s111, d1s155e, d1s166e, d1s1733e, d1s2223e, d1s61, d2h, d2s201e, d2s448, d2s488e, d2s69e, d3s1231e, d3s1319e, d3s48e, d4, d4s90, d5s1708, d5s346, d6, d6s1101, d6s207e, d6s2245e, d6s228e, d6s229e, d6s230e, d6s231e, d6s51e, d6s52e, d6s54e, d6s81e, d6s82e, d7s437, d8s2298e, d9s46e, da1, da2b, dab2, dac, dad1, daf, dag, dag1, dag2, dagk1, dagk4, dam10, dam6, damox, dan, dao, dap, dap3, dap5, dapk1, dar, dat1, dax1, daxx, daz, dazh, daz1, dba, dbccr1, dbcn, dbh, dbi, dbi, db1, dbm, dbn1, dbp, dbp, dbp1, dbp2, dbpa, dbt, dbx, dby, dcc, dce, dci, dck, dcn, dcoh, dcp1, dcr, dcr3, dct, dctn1, dcx, ddb1, ddb2, ddc, ddh1, ddh2, ddit1, ddit3, ddost, ddp, ddpac, ddr, ddx1, ddx10, ddx11, ddx12, ddx15, ddx16, ddx2a, ddx3, ddx5, ddx6, ddx9, dec, decr, def1, def4, def5, def6, defa1, defa4, defa5, defa6, defb1, defb2, dek, denn, dents, dep1, der12, des, dff1, dffa, dffrx, dffry, dfn1, dfn2, dfn3, dfn4, dfn6, dfna1, dfna10, dfna11, dfna12, dfna13, dfna2, dfna2, dfna4, dfna5, dfna6, dfna7, dfna8, dfna9, dfnb1, dfnb12, dfnb13, dfnb14, dfnb16, dfnb17, dfnb18, dfnb2, dfnb3, dfnb4, dfnb5, dfnb6, dfnb7, dfnb8, dfnb9, dgcr, dgcr2, dgcr2, dgcr6, dgi1, dgka, dgkq, dgpt, dgpt, dgs, dgs2, dgsi, dgu, dhc2, dhcr7, dhfr, dhlag, dhp, dhpr, dhps, dhrd, dhtr, di, di1, dia, dia1, dia2, dia4, diaph1, diaph2, dif2, diff6, dipi, dir, dkc, dkc1, dlc1, dld, dlg1, dlg2, dlg3, dlg4, dlst, dlx1, dlx2, dlx2, dl3, dlx4, dlx5, dlx6, dlx7, dlx8, dm, dm2, dmahp, dmbt1, dmd, dmda1, dmd1, dmh, dmk, dmp1, dmpk, dmsfh, dmt, dmt1, dmtn, dna21, dnah, dnah1, dnah11, dnah12, dnah2, dnahc1, dnahc11, dnahc2, dnahc3, dnase1, dnase111, dnase113, dnase2, dnch2, dnc1, dncm, dnec1, dne11, dn1, dn11, dn111, dnm1, dnmt1, dnmt2, dnpk1, dns, dntt, do, doc1, doc2, dock1, dock180, dod, dok1, dom, dp1, dp1, dp2, dp3, dpagt2, dpc4, dpd, dpde1, dpde2, dpde3, dpde4, dpep1, dph212, dpp, dpp4, dpp6, dpt, dpyd, dpys, dpys11, dpys12, dr1, dr3, dr31g, dr5, dra, drad, drada, dra1, drd1, drd1b, drd1b, drd112, drd2, drd3, drd4, drd5, dri11, drp1, drp1, drp2, drp2, drp3, drp1a, drt, dsc1, dsc2, dsc3, dsc3, dsc4, dscam, dscr, dsg1, dsg2, dsg3, dsp, dspg3, dspp, dss, dss1, dtd, dtdp2, dtdst, dtna, dtr, dts, dus, dusp1, dusp11, dusp2, dusp3, dusp4, dusp5, dusp6, dusp7, dusp8, dut, dv1, dv11, dv11, dv13, dxf68s1e, dxs1272e, dxs128, dxs1283e, dxs423e, dxs435e, dxs522e, dxs648, dxs707, dxs8237e, dxys155e, dylx2, dyrk, dys, dysf, dyt1, dyt3, dyt5, dyt6, dyt7, dyt8, dyt9, dyx1, dyx2, e11s, e14, e1b, e2a, e2f1, e2f2, e2f3, e2f4, e3, e4f, e4f1, e4tf1a, e4tf1b, eal, eaac1, eaat1, eaat2, eac, ead, eag, eap, earl, ear2, ear3, ebaf, ebf, ebi1, ebm, ebn1, ebn1, ebn2, ebr2a, ebs1, ebvm1, ebvs1, ec1, eca1, ecb2, ece1, ecgf1, ech1, echs1, eck, ecm1, ecp, ecs1, ect2, ed1, ed2, ed3, ed4, eda, eda3, eddr1, edg3, edg6, edh, edh17b2, edh17b2, edh1, edm1, edm2, edm3, edmd, edmd2, edn, edn 1, edn2, edn3, ednra, ednrb, eec1, eec2, eef1a1, eef1a2, eef1b1, eef1b2, eef1b3, eef1b4, eef2, eeg1, eegv1, eek, een, ef1a, ef2, efe2, efemp1, efl6, efmr, efna1, efna3, efna4, efnb1, efnb2, efnb3, efp, eftu, egf, egfr, egi, egr1, egr2, egr3, egr4, ehhadh, ehoc1, ei, eif1a, eif2g A, eif2s3 A, eif3s10, eif3s6, eif4a1, eif4a2, eif4c, eif4e, eif4ebp1, eif4e2, eif4e11, eif4e12, eif4g, eif4g1, eif4g2, eif5a, ejm1, el1, ela1, ela2, elam1, elanh2, elav11, elav12, elav14, elc, ele1, elf3, elk1, elk2, elk3, elk4, el1, eln, em9, emap, emap1, emd, emd2, emk1, emp1, emp55, emr1, ems1, emt, emtb, emx1, emx2, en1, en2, ena78, end, endog, enfl2, eng, en1, eno1, eno1, eno3, enpep, ent1, entk, enur1, enur2, enx2, eos, ep3, ep300, epa, epb3, epb311, epb41, epb4112, epb42, epb49, epb72, epha1, epha2, epha3, epha8, ephb1, ephb2, ephb3, ephb4, ephb6, epht1, epht2, epht3, ephx1, epha2, epim, eplg1, eplg2, eplg3, eplg4, eplg5, eplg8, epm1, epm2, epm2a, epmr, epo, epor, eppk, eprs, eps15, eps8, ept, erba1, erba2, erba12, erba13, erbb2, erbb3, erbb4, erc55, ercc1, ercc2, ercc3, ercc4, ercc5, ercc6, ercm1, erda1, erf1, erg, erg3, ergic53, erh, erk, erk1, erk2, erk3, erm, erp11, erv1, erv1, erv3, ervr, ervt1ervt2, ervt3, ervt4, ervt5, eryf1, es1, es130, esa, esa1, esa4, esat, esb3, esd, esg, esr, esr1, esr2, esr11, esr12, esrra, esrrb, esrrg, ess1, est, est, est2, est25263, esx, etfa, etfb, etfdh, etk1, etk2, etm1, etm2, eto, ets1, ets2, etyl, etv3, etv4, etv5, etv6, evc, evc1, evda, evdb, evi1, evi2, evi2a, evi2b, evp1, evr1, evr1, evx1, evx2, ews, ewsr1, exlm1, ext1, ext2, ext3, ext 11, ext12, eya1, eya2, eya3, eyc11, eyc13, ezh1, ezh1, ezh2, f10, f11, f12, f13a, f13a1, f13b, f2, f2r, f2rl2, f2rl3, f3, f5, f5f8d, f7, f7e, f7r, f8a, f8b, f8c, f8vwf, f9, fa, fa1, faa, fabp1, fabp2fabp3, fabp4, fabp6, fac1, faca, facc, facd, face, fac11, fac12, fac13, fac14, facv11, fad, fadd, fadk, fah, fak2, faldh, fal139, falz, fanca, fancc, fancd, fance, fancg, fap, fapa, farr, fas, fas1, fasn, fast1, fat, fau, fbln1, fbln2, fbn1, fbn2, fbn1, fbp1, fcar, fcc1, fce, fce2, fcer1a, fcer1b, fcer1g, fcer2, fcgr1a, fcgr1b, fcgr1c, fcgr2a, fcgr3a, fcgrt, fcmd, fcn1, fcn2, fcp, fcp1, fcpx, fct3a, fdc, fdft1, fdh, fdps11, fdps12, fdpsl3, fdps14, fdps15, fdx1, fdxr, fe65, fe6511, fea, feb1, feb2, fecb, fech, fen1, feo, feom, feom1, feom2, fer, fes, fet1, fevr, ffm, fga, fgarat, fgb, fgc@, fgd1, fgdy, fgf1, fgf10, fgf11, fgf12, fgf13, fgf14, fgf2, fgf2, fgf3, fgf4, fgf5, fgf6, fgf1, fgf8, faf9, fgfa, fgfb, fgfr1, fgfr2, fgfr3, fgfr4, fgg, fgr, fgs1, fh, fh, fh3, fhc, fnf1, fhf3, fhf4, fhh2, fhit, fh11, fh12, fhr2, fic1, figf, fih, fim, fim1, fim3, fimg, fkbp12, fkbp1a, fkbp2, fkh2, fkh11, fkh110, fkh112, fkh115, fkh116, fkh117, fkh12, fkh15, fkh16, fkh17, fkh18, fkh19, fkhr, fkhr11, flg, fli1, flii, fln1, fln2, flna, flnb, flnms, flot2, flt1, flt2, flt3, flt4, fmf, fmn, fmo1, fmo2, fmo3, fmod, fmr1, fmr2, fms, fl1, fn12, fnra, fnrb, fnrb1, fnta, fntb, folh, folh1, folr1, folr2, folt, fos, fosb, fos11, fos12, fpah, fpc, fpd1, fpdmm, fpf, fpgs, fp1, fpp, fpr1, fprh1, fprh2, fprl 1, fpr12, fprp, fps12, fps13, fps14, fps15, fr, frap1, fraxa, fraxe, fraxf, frda, freac2, freac6, freac9, frg1, frp1, frv1, frv2, frv3, fsg1, fsgs, fshb, fshd1a, fshmd1a, fshprh1, fshr, fssv, fth1, fth16, ft1, ftz1, ftzf1, fuca1, fuca2, fur, fus, fuse, fut1, fut2, fut3, fut4, fut5, fut6, fut7, fut8, fvt1, fxr1, fxy, fy, fyn, fzd1, fzd2, fzd3, fzd5, fzd6, fzd7, fzr, g0s8, g10p1, g10p2, g17, g17p1, g19p1, g1p1, g1p2, g1p3, g22p1, g6pc, g6pd, g6pd1, g6pd1, g6pt, g6pt1, g6s, g7p1, ga2, gaa, gabatr, gabpa, gabpb1, gabra1, gabra2, gabra3, gabra4, gabra5, gabra6, gabrb1, gabrb2, gabrb3, gabrd, gabre, gabrg1, gabrg2, gabrg3, gabrr1, gabrr2, gad1, gad2, gad3, gadd153, gadd45, gak, ga1, galbp, galc, gale, galgt, galk1, galk2, gain, galnact, galnr, galnr1, galns, galnt1, galnt2, galnt3, galr1, galt, gan, gan1, ganab, ganc, gap, gap1m, gap43, gapd, gar22, garp, gars, gart, gas, gas1, gas2, gas41, gash, gas7, gasr, gast, gata1, gata2, gata3, gata4, gata6, gay1, gba, gbas, gbbb1, gbbb2, gbe1, gbp1, gbx2, gc, gcap, gcap2, gcdh, gcf1, gcf2, gcfx, gcg, gcgr, gch1, gck, gckr, gcn511, gcn512, gcnf, gcnt1, gcnt2, gcp, gcp2, gcs, gcs1, gcsf, gcsfr, gcsp, gctg, gcy, gda, gde, gdf5, gdf8, gdh, gdi1, gdi2, gdid4, gd1d, gdnf, gdnfr, gdnfra, gdnfrb, gdx, gdxy, ge, gem, geney, gey, gf1, gfl, gfap, gfer, gfer, gfi1, gfpt, gfra1, gfra2, ggcx, ggt1, ggt2, ggta1, ggtb1, ggtb2, gh1, gh2, Ghc®, ghdx, ghn, ghr, ghrf, ghrh, ghrhr, ghs, ghv, gif, gift, gip, gip, gipr, girk1, girk2, girk3, girk4, gja1, gja3, gja4, gja5, gja8, gjbl, gjb2, gjb3, gk, gk2, gla, glat, glb1, glb2, glc1a, glc1b, glc1c, gic1d, gic1f, glc3a, glc3b, glc1c, glc1r, glct2, glct3, gldc, glepp1, glg1, gli, gli2, gli3, gli4, glnn, glns, glo1, glo2, glp1r, glra1, glra2, glra3, glrb, glrx, gls, glud1, glud2, glu1, glur1, glur2, glur3, glur4, glur5, glur6, glur7, glut1, glut2, glut3, glut4, glut5, glvr1, givr2, gly96, glya, glyb, glys1, glyt1, glyt1, glyt2, gm2a, gma, gmcsf, gmds, gm1, gmpr, gmps, gnal1, gnal5, gnal6, gnai1, gnai2, gnai2a, gnai2b, gnai21, gnai3, gna1, gnao1, gnaq, gnas, gnas1, gnat1, gnat2, gnaz, gnb1, gnb2, gnb3, gng5, gn11, gnpta, gnrh1, gnrh2, gnrhr, gns, gnt1, golga4, got1, got2, gp130, gp1ba, gp1bb, gp2, gp2b, gp39, gp3a, gp75, gp78, gp9, gpa, gpam, gpat, gpb, gpc, gpc1, gpc3, gpc4, gpd, gpd1, gpd2, gpds1, gpe, gpi, gpi2, gpm6a, gpm6b, gpoa, gpr1, gpr10, gpr11, gpr12, gpr13, gpr15, gpr17, gpr18, gpr19, gpr2, gpr20, gpr21, gpr22, gpr23, gpr25, gpr29, gpr3, gpr30, gpr31, gpr32, gpr35, gpr37, gpr39, gpr4, gpr5, gpr6, gpr7, gpr8, gpr9, gprcy4, gprk21, gprk4, gprk5, gprk6, gprv28, gpsa, gpsc, gpt, gpx1, gpx2, gpx3, gpx4, gr2, grb1, grb10, grb2, grf2, gria1, gria2, gria3, gria4, grid2, grik1, grik2, grik3, grik4, grik5, grin1, grin2a, grin2b, grin2c, grin2d, grina, grk1, grk5, grk6, gr1, gr111, grm3, grm8, grmp, grn, gro1, gro2, gro3, grp, grp58, grp78, grpr, grx, gs, gs1, gsas, gsc, gsc1, gse, gshs, gs1, gsm 1, gsn, gsp, gspt 1, gsr, gss, gst 12, gst11, gst2, gst2, gst3, gst4, gst5, gsta1, gsta2, gstm1, gstm11, gstm2, gstm3, gstm4, gstm5, gstp1, gstt2, gt1, gt335, gta, gtb, gtbp, gtd, gtf2e2, gtf2f1, gtf2h1, gtf2h2, gtf2h4, gtf2i, gtf2s, gtf3a, gtg, guc1a2, guc1a3, guc1b3, guc2c, guc2d, guc2f, guca1a, guca1b, guca2, guca2, guca2a, guca2b, gucsa3, gucsb3, gucy1a2, gucy1a3, gucy1b3, gucy2c, gucy2d, gucy2f, guk1, guk2, gu1o, gu1op, gusb, gusm, gust, gxp1, gypa, gypb, gypc, gype, gys, gys1, gys2, gzma, gzmb, gzmh, gzmm, h, h142t, h19, h1f0, h1f1, h1f2, h1f3, h1f4, h1f5, h1fv, h2a, h2ax, h2az, h2b, h2b, h3f2, h3f3b, h3 ft, h3t, h4, h4f2, h4f5, h4fa, h4fb, h4fe, h4fg, h4fh, h4f1, h4fj, h4fk, h4f1, h4fm, h4m, h6, ha2, habp1, hadha, hadhb, hadhsc, haf, hagh, hah1, habp1, ha1, hap, hap1, hap2, hars, has2, hat1, hausp, hb1, hb1, hb6, hba1, hba2, hbac@, hbb, hbbc@, hbd, hbe1, hbegf, hbf2, hbg1, hbg2, hbgr, hbhr, hbm, hbp, hbq1, hbz, hc2, hc3, hca, hcat2, hccs, hcdh, hcf2, hcfc1, hcg, hck, h11, hc12, hc13, hcls1, hcp, hcp1, hcs, hcvs, hd, hdac1, hdc, hdgf, hdhc7, hdlbp, hdld, hdldt1, hdr, hed, hed, hegf1, hek, hek3, heln1, hem1, hema, hemb, hemc, hempas, hen1, hen2, hep, hep10, her2, her4, herg, herv1, hes1, hesx1, het, hexa, hexb, hf1, hf10, hfc1, hfe, hfe2, hfh11, hfsp, hgd, hgf, hgf, hgf1, hg1, hh, hh72, hhc1, hhc2, hhd, hhh, hhmjg, hhr23a, hht1, hht2, hiap2, higm1, hilda, hint, hiomt, hip, hip1, hip116, hip2, hir, hira, his1, hist, hive1, hivep1, hivep2, hjcd, hk1, hk2, hk3, hk33, hke4, hke6, hkr1, hkr2, hkr3, hkr4, hl11, hl19, hla-a, hla-b, hia-c, hla-cda12, hla-dma, hla-dmb, hla-dna, hla-dob, hla-dpa1hla-dpb1, hla-dqa1, hla-drlb, hia-dra, hla-e, hla-f, hla-g, hla-ha2, hladp, hlaf, hlals, hlcs, hlm2, hlp, hlp3, hlrl, hlr2, hlt, hlx1, hlxb9, hmaa, hmab, hmat1, hmbs, hmcs, hmg1, hmg14, hmg17, hmg2, hmgc1, hmgcr, hmgcs1, hmgcs2, hmgic, hmgiy, hmgx, hmmr, hmn2, hmox1, hmox2, hmr, hms1, hmsn1, hmx1, hmx2, hnd, hnf1a, hnf2, hnf3a, hnf3b, hnf4a, hnp36, hnpcc6, hnrpa1, hnrpa2b1, hnrpd, hnrpf, hnrpg, hnrph1, hnrph2, hnrph3, hnrpk, homg, hops, hox10, hox11, hox12, hox1@, hox1a, hox1b, hox1c, hox1d, hox1e, hox1f, hox1g, hox1h, hox1i, hox1j, hox2@, hox2a, hox2b, hox2c, hox2d, hox2e, hox2f, hox2g, hox2h, hox2i, hox3@, hox3a, hox3b, hox3c, hox3d, hox3e, hox3f, hox3g, hox4@, hox4a, hox4b, hox4c, hox4d, hox4e, hox4f, hox4g, hox4h, hox4i, hox7, hox8, hoxa1, hoxa10, hoxa11, hoxa13, hoxa3, hoxa4, hoxa5, hoxa6, hoxa7, hoxa9, hoxa@, hoxb1, hoxb2, hoxb3, hoxb4, hoxb5, hoxb6, hoxb7, hoxb8, hoxb9, hoxb@, hoxc12, hoxc13, hoxc4, hoxc5, hoxc6, hoxc8, hoxc9, hoxc@, hoxd1, hoxd10, hoxd11, hoxd12, hoxd13, hoxd3, hoxd4, hoxd8, hoxd9, hoxd@, hoxhb9, hp, hp4, hpafp, hpc1, hpc2, hpca, hpca11, hpcx, hpd, hpdr1, hpdr2, hpe1, hpe2, hpe3, hpe4, hpe5, hpect1, hpfh, hpfh2, hpgd, hplh1, hplh2, hpn, hpr, hprt, hprt1, hps, hpt, hpt1, hptp, hptx, hpv18i1, hpv18i2, hpx, hr, hras, hrb, hrc, hrc1, hrca1, hrd, hres1, hrf, hrg, hrga, hrh1, hrh2, hrmt111, hrpt2, hrx, hrx, hry, hsa11, hsa12, hsan1, hsan1, hscr2, hsd11, hsd11b1, hsd11b2, hsd11k, hsd111, hsd17b1, hsd17b2, hsd17b3, hsd17b4, hsd3b1, hsd3b2, hsh, hsn1, hsorc1, hsp27, hsp73, hspa1a, hspa1b, hspa11, hspa2, hspa3, hspa4, hspa5, hspa6, hspa7, hspa8, hspa9, hspb1, hspb2, hspc2, hspca11, hspca12, hspca13, hspca14, hspcb, hspg1, hspg2, hsr1, hsst, hstd, hstf1, htc2, htf4, htk, htk1, ht1, htlf, htlvr, htn1, htn2, htn3, htnb, htor, htr1a, htr1b, htr1d, htr1e, htr1e1, htr1f, htr2a, htr2b, htr2c, htr3, htr4, htr5a, htr6, htr7, htrx1, hts1, htt, htx, htx1, hub, hud, hup2, hur, hus, hvls, hvbs1, hvbs6, hvbs7, hvem, hvh2, hvh3, hvh8, hxb, hxb1, hy, hya, hyal1, hyd2, hygn1, hy1, hyp, hyplip1, hypp, hypx, hyr, hyrc1, hys, ia1, ia2, iap, iapp, iar, iars, ibd1, ibd2, ibm2, ibsp, ica1, icam1, icam2, icam3, icca, ich1, icr2, icr2b, ics1, id1, id2, id3, id4, ida, idd, iddm1, iddm10, iddm11, iddm12, iddm13, iddm15, iddm17, iddm2, iddm3, iddm4, iddm5, iddm6, iddm7, iddm8, iddmx, ide, idg2, idh1, idh2, idh3a, idh3g, ido, ids, idua, ier1, ier3, iex1, if, ifcr, ifgr2, ifi16, ifi27, ifi35, ifi4, ifi5111, ifi54, ifi56, ifi616, ifi78, ifna1, ifna10, ifna16, ifna17, ifna21, ifna6, ifna7, ifna8, ifna@, ifnai1, ifnar1, ifnar2, ifnb1, ifnb2, ifnb3, ifng, ifngr1, ifngr2, ifngt1, ifnr, ifnw1, ifrd2, iga, igat, igb, igbp1, igd1, igda1, igdc1, igds2, iger, iges, igf1, igf1r, igf2, igf2r, igfbp1, igfbp10, igfbp2, igfbp3, igfbp4, igfbp6, igfbp7, igfr1, igfr2, igfr3, igh@, igha1, igha2, ighd, ighdy2, ighe, ighg1, ighg2, ighg3, ighg4, ighj, ighm, ighmbp2, ighr, ighv@, igi, igh igk@, igkc, igkde1, igkj, igkjrb1, igkv, iglc, iglc1, ig1j, iglp1, iglp2, iglv, igm, igo1, igsf1, ihh, ik1, ikba, il10, il10r, il11, il11ra, il12a, il12b, il12rb1, il12rb2, il13, il13ra1, il13ra2, il15, il15ra, il17, il1a, il1b, il1bc, il1r1, il1r2, il1ra, il1rap, il1rb, il1rn, il2, il2r, 112ra, il2rb, il2rg, il3, il3ra, il3ray, il4, il4r, il4ra, il5, il5ra, il6, il6r, il6st, il7, il7r, il8, il8ra, il8rb, il9, il9r, ila, ilf1, illbp, imd1, imd2, imd4, imd5, imd6, impa1, impdh1, impdh2, impdh11, impg1, impt1, indx, infa2, infa4, infa5, ing1, inha, inhba, inhbb, inhbc, ini1, ink4b, inlu, inp10, inpp1, inpp5a, inpp5b, inpp5d, inpp11, ins, insig1, ins1, ins13, insl4, insr, insrr, int1, int111, int2, int3, int4, int6, iosca, ip2, ipf1, ip1, ipm150, ipox, ipp, ipp2, ipw, iqgap1, ir10, ir20, ireb1, ireb2, irf1, irf2, irf4, irf4, irr, irs1, isa, iscw, is11, islr, isot, issx, it15, itba1, itba2, itf, itf2, itga1, itga2, itga2b, itga4, itga5, itga6, itga7, itgad, itga1, itgam, itgav, itgax, itgb1, itgb2, itgb3, itgb4, itgb6, itgb7, iti, itih1, itih2, itih3, itih4, itih11, iti1, itk, itm1, itpa, itpka, itpkb, itpr1, itpr2, itpr3, itsn, ivd, iv1, jag1, jak1, jak2, jak3, jbs, jcap, jh8, jip, jk, jme, jmj, joag, jpd, jrk, jrk1, jtk14, jtv1, jun, junb, jund, jup, jv18, jws, k12t, kai1, kal1, kar, kars, katp1, kcna1, kcna10, kcna1b, kcna2b, kcna3, kcna4, kcna5, kcna6, kcna7, kcna8, kcna9, kcnab1, kcnab2, kcnb1, kcnc1, kcnc2, kcnc3, kcnc4, kcne1, kcnh1, kcnh2, kcnj1, kcnj10, kcnj11, kcnj12, kcnj15, kcnj3, kcnj4, kcnj5, kcnj6, kcnj6, kcnj7, kcnj8, kcnjn1, kcnk1, kcnk3, kcnma1, kcnq1, kcnq2, kcnq3, kcnq4, kcns2, kd, kdr, ke1, kera, kf1, kfs, kfsd, khk, kiaa0122, kid, kid1, kif2, kif3c, kif5b, kip1, kip2, kiss1, kit, klc2, klk1, klk2, klk3, klk3, klkb1, klkr, klrb1, klrc1, klrc2, klrc3, klrc4, klrd1, klst, kms, kms, kng, kno, kns1, kns2, kns11, kns14, kox1, kox11, kox12, kox13, kox15, kox16, kox18, kox19, kox2, kox22, kox25, kox30, kox32, kox4, kox5, kox6, kox7, kox9, kpna3, kpps1, kpps2, krag, kras1p, kras2, krev1, krg2, krn1, krn11, krox20, krt1, krt10, krt12, krt13, krt14, krt 15, krt16, krt17, krt18, krt19, krt2a, krt2e, krt3, krt4, krt5, krt6a, krt6b, krt7, krt8, krt9, krtha2, krtha5, krthb1, krthb6, ks, ktn1, ku70, kup, kv1qt1, kwe, 11.2, 11cam, 123mrp, lab7, lab72, lac, laci, lacs, lad, lad, lad1, laf4, lag3, lag5, lair1, lak1, lalba, lal1, lam1, lama1, lama2, lama3, lama3, lama4, lama5, lamb1, lamb2, lamb2, lamb2t, lamb3, lambr, lamc1, lamc2, lamm, lamnb2, lamp, lamp1, lamp2, lamr1, lams, lap, lap18, laptm5, lar, lar1, lard, large, tars, lbp, lbr, lca, lca1, lcad, lcamb, lcat, lccs, lcfs2, lch, lck, lcn1, lcn2, lco, lcp1, lcp2, lct, ld, ld78, ldb1, ldb2, ldc, ldh1, ldh3, ldha, ldhb, ldhc, ldlr, le, lect2, lef1, lefty1, lefty2, lep, lepr, lerk5, lerk8, leu1, leu7, leut, lfa1a, lfa3, lfh11, lfp, lgals1, lgals3, lgals3 bp, lgals7, lgcr, lgmd1, lgmd1a, lgmd1b, lgmd1c, lgmd1d, lgmd2b, lgmd2c, lgmd2d, lgmd2e, lgmd2f, lgmd2g, lgmd2h, lgs, lgtn, lhb, lhcgr, lhs, lhx1, lhx3, li, li2, lif, lifr, lig1, lig3, lig4, lim1, lim2, limab1, limk1, limpii, lip2, lipa, lipb, lipc, lipd, lipe, lipo, lis1, lis2, lisx, litaf, lkbl, lknl, llg11, lman1, lmn1, lmn2, lmna, lmnb1, lmnb2, lmo1, lmo2, lmo3, lmo4, lmo5, lmp10, lmp2, lmp7, lmpx, lms, lmx1, lmx1a, lmx1b, lmyc, lnhr, lnrh, locr, loh11cr2a, lor, lot1, lox, lox1, lox11, lpa, lpaab, lpaata, lpap lpc1, lpc2d, lpd1, lph, lpi, lp1, lpna3, lpp, lps, lpsa, lqt1, lqt2, lqt3, lqt4, lr3, lre1, lre2, lrp, lrp1, lrp2, lrp5, lrp7, lrp8, lrpap1, lrpr1, lrs1, lsamp, lsirf, ls1, lsn, lspl, lss, lst1, lta, lta4h, ltb, ltb4r, ltbp1, ltbp2, ltbp2, ltbp3, ltbp3, ltbr, ltc4s, ltf, ltk, ltn, lu, lum, luxs, luzp, lw, ly64, ly6e, ly9, lyam1, lyb2, lyf1, lyl1, lyn, lyp, lyst, lyt10, lyz, lztr1, m11s1, m130, m17s1, m17s2, m195, m1s1, m3s1, m4s1, m6a, m6b, m6p2, m6pr, m6s1, m7v1, m7vs1, mab211, mac1a, mac2, mac25, macam1, macs, mad, mad211, madd, madh1, madh2, madh3, madh4, madh5, madh6, madh6, madh7, madh9, madm, madr1, maf, mafd1, mafd2, mag, mage1, mageb3, mageb4, magel 1, magoh, magp, magp1, magp2, mak, ma1, ma11, man2a2, mana1, mana2, mana2x, manb, manb1, manba, maoa, maob, map1a, map1a1c3, map1b, map1b1c3, map2, map4, map80, map97, mapk1, mapkap3, mapkkk4, mapt, mar, mark3, mars, mas1, masp1, mat1a, mat2a, mata1, mata2, matk, matn1, matn3, max, maz, mb, mbd1, mb1, mb12, mbp, mbp1, mbs, mbs2, mc1r, mc2r, mc3r, mc4r, mc5r, mcad, mcc, mcdc1, mcdr1, mcf2, mcf3, mcfd1, mch2, mch3, mch4, mch5, mckd, mc1, mc11, mcm, mcm2, mcm2, mcm3, mcm6, mcm7, mcmt, mcop, mcor, mcp, mcp1, mcp3, mcph1, mcr, mcs, mcsf, mcsp, mct1, md1, mdb, mdc, mdcr, mddc, mdeg, mdf1, mdg, mdg1, mdh1, mdh2, mdk, mdk, mdm2, mdm4, mdr1, mdr3, mdrs1, mdrv, mds, mds1, mdu1, mdu2, mdu3, mdx, me1, met, mea, mea6, mec11, mecp2, med, mef, mef2a, mef2b, mef2c, mef2d, mefv, mehmo, meis1, meis2, mekk, mekk1, mekk4, me1, mel18, melf, memo1, men1, men2a, meox1, meox2, mep1a, mep1b, mer2, mer6, mest, met, metrs, mfap1, mfap2, mfap3, mfap4, mfd1, mfi2, mfs1, mfs2, mft, mfts, mg50, mga, mga1, mga3, mgat1, mgat2, mgat5, mgc1, mgcn, mgcr, mgct, mgdf, mgea, mgf, mgi, mgmt, mgp, mgsa, mgst1, mgst2, mhc, mhc7ta, mhp2, mhs, mhs2, mhs3, mhs4, mhs6, mia, mic10, mic11, mic12, mic17, mic18, mic2, mic2x, mic2y, mic3, mic4, mic7, mica, micb, mid1, midas, mif, mif, mig, mip, mip2a, mip2b, mip3b, mipep, mitf, miwc, mjd, mk, mki67, mkks, mkp2, mkp3, mkpx, mks, mks, mks1, mks2, mla1, mlck, mlf1, mlf2, mlh1, mlk1, mlk3, ml1, ml12, ml1t1, ml1t2, ml1t3, ml1t4, ml1t6, ml1t7, mlm, mlm, mln, mlp, mlr, mlrg, mlrw, mls, mltn, mlvar, mlvi2, mlvt, mmac1, mme, mmp1, mmp10, mmp11, mmp12, mmp13, mmp14, mmp15, mmpl6, mmp17, mmp19, mmp2, mmp21, mmp22, mmp3, mmp7, mmp8, mmp9, mn, mn, mnb, mnbh, mnda, mng1, mnk, mns, mnt, mocod, mocs1, mocs2, mody1, mody3, mog, mok2, mom1, mos, mot2, mov34, mox1, mox2, mox44, moz, mp19, mpb1, mpd1, mpdz, mpe, mpe16, mpg, mpi, mpif2, mp1, mp11g, mpo, mpp1, mpp2, mpp3, mppb, mpri, mprn, mps2, mps3a, mps3c, mps4a, mpsh, mpts, mpv17, mpz, mr1, mr77, mrbc, mrc1, mre11, mre11a, mrg1, mrgh, mros, mrp, mrp, mrp1, mrp123, mrs, mrsd, mrsr, mrst, mrx1, mrx14, mrx2, mrx20, mrx21, mrx23, mrx29, mrx41, mrx48, mrx49, mrx9, mrxa, mrxs1, mrxs2, mrxs3, mrxs4, mrxs5, mrxs6, mrxs8, ms3315, ms336, msg1, msh2, msh3, msh4, msh6, msi1, mskl6, msk39, msk41, mslr1, msmb, msn, msr1, mss1, mss4, mss4, msse, mst, mst1, mst1r, mstd, mstn, msud1, msx1, msx2, mt1a, mt1b, mt1e, mt1f, mt1g, mt1 h, mt1i, mt1j, mt1k, mt1l, mt1x, mt2, mt2a, mt3, mtacr1, mtap, mtbt1, mtcp1, mterf, mtf1, mth1, mthfc, mthfd, mthfr, mtk1, mtm1, mtmr1, mtmx, mtnr1a, mtnr1b, mtp, mtpa, mtr, mtrns, mtrr, mts, mts, mts1, mts1, mts2, mttf1, mtx, mtxn, mu, muc1, muc2, muc3, muc4, muc5, muc5ac, muc5b, muc6, muc8, mu1, mum1, mupp1, musk, mut, mvk, mvlk, mvwf, mwfe, mx, mx1, mx2, mxi1, mxs1, myb, myb11, myb12, mybpc1, mybpc2, mybpc3, mybpcf, mybph, myc, myc11, myc12, myclk1, mycn, myd88, myf3, myf4, myf5, myf6, myh1, myh10, myh11, myh12, myh2, myh3, myh4, myh6, myh7, myh8, myh9, myk1, my1, my11, my12, my13, my14, my15, mylk, mymy, myo10, myo15, myo1a, myo1c, myo1d, myo1e, myo5a, myo6, myo7a, myo9b, myoc, myod1, myog, myp1, myp2, myp3, myr5, mzf1, n33, nab1, nab2, nabc1, nac1a, naca, nacae, nacp, nadmr, naga, nagc@, naglu, nagr1, naip, namsd, nanta3, nap114, nap2, nap21, napb, naptb, nars, nat1, nat1, nat2, nb, nb4s, nbat, nbc3, nbccs, nbccs, nbia1, nbs, nbs, nbs1, nca, ncad, ncam1, ncan, ncbp, ncc1, ncc2, ncc3, ncc4, ncct, ncf1, ncf2, ncf4, nck, nc1, ncst2, ncx1, ncx2, nd, ndhii, ndn, ndp, ndst1, ndufa1, ndufa2, ndufa5, ndufa6, ndufa7, ndufb8, ndufb9, ndufs1, ndufs2, ndufs4, ndufs7, ndufs8, ndufv1, ndufv2, ndufv3, neb, nec1, nec2, nedd1, nedd2, nedd4, nefh, nef1, negf1, negf2, ne111, neb112, nem1, neo1, nep, net, net1, neu, neu, neud4, neurod, neurod2, neurod3, nf1, nf1a, nf2, nfatc1, nfatc2, nfatp, nfe1, nfe2, nfe211, nfe212, nfe2u, nfia, nfib, nfic, nfix, nfkb1, nfkb2, nfkb3, nfkbia, nfkbi11, nfrkb, nfya, nfyb, ngal, ngbe, ngfb, ngfg, ngfic, ngfr, ng1, ngn, nhbp, nhcp1, nhcp2, nhe1, nhe3, nhe4, nhe5, nhlh1, nhlh2, nhp211, nhs, nid, niddm1, ninj1, nipp1, nipsnap1, nipsnap2, nis, nklr, nkcc1, nkcc2, nkg2, nkg2a, nkg2c, nkg2e, nkg2f, nkhc, nkna, nknar, nknb, nkrp1a, nks1, nksf2, nktr, nkx2a, nkx3.2, nkx3a, nkx6a, nli, nm, nm1, nm23, nmb, nmbr, nmdar1, nmdar2a, nmdar2b, nmdar2c, nmdar2d, nmdara1, nme1, nme2, nme4, nmor1, nmor2, nms1, nmyc, nnat, nmnt, nno1, nog, noll, nos1, nos2a, nos2b, nos2c, nos3, not, notch1, notch2, notch3, notch4, nov, nov, nov2, nova1, nova3, novp, np, np10, npat, npc, npc1, npd, nph1, nph2, nphl2, nphn, nphp1, nphp2, nphs1, npm1, nppa, nppb, nppc, npps, npr1, npr2, npr3, nps1, npt1, npt2, nptx2, npy, npy1r, npy2r, npy3r, npy5r, npy6r, nqo2, nramp, nramp1, nramp2, nrap, nras, nrb54, nrcam, nrd1, nrf1, nrf1, nrf2, nrgn, nrip1, nrk2, nr1, nrtn, nru, ns1, nsf, nsp, nsp11, nsrd9, nt4, nt5, nt5, ntcp1, ntcp2, ntf3, ntf4, ntf5, nth11, ntn, ntn, ntn21, ntrk1, ntrk2, ntrk3, ntrk4, ntrkr1, ntrkr3, nts, ntt, ntt, nuc1, nucb1, numa1, nup214, nup98, nurr1, ny1, nys1, nys2, nysa, oa1, oat2oa3, oar, oasd, oat, oat11, oat22, oat23, oatp, oaz, ob, ob10, obf1, obp, obr, oca2, ocm, ocp2, ocr1, ocr11, oct, oct1, oct2, oct2, oct3, oct7, octn2, octs3, odc1, oddd, odf1, odg1, odod, ofc1, ofc2, ofc3, ofd1, ofe og22, ogdh, ogg1, ogr1, ogs1s, ogs2, ohds, ohs, oias, oip1, ok, olf1, olfmf, olfr1, olfr2, omg, omgp, omp, on, op2, opa1, opa1, opa3, opca3, opcm1, opd1, opg1, ophn1, op11, opn, oppg, oprd1, oprk1, oprm1, oprt, opta2, optb1, oqt1, orld2, orlf1, orc11, orc21, orc41, orc51, orfx, orm1, orm2, orw, osbp, osm, osp, ost, ost48, osx, otc, otf1, otf2, otf3, otm, otof, ots, otx1, otx2, ovc, ovcs, ovo11, ox40, oxa11, oxct, oxt, oxtr, ozf, p, p, p1, p15, p16, p167, p28, p2rx3, p2rx4, p2ry1, p2ry2, p2ry4, p2ry7, p2u, p2x3, p2x4, p2y1, p2y2, p2y2, p2y4, p3p40phox, p450c11, p450c17, p450c2a, p450c2d, p450c2e, p450scc, p4ha, p4ha1, p4ha1, p4hb, p5cdh, p79r, pa2g4, pab1, pab2, pabp2, pabp11, pac1, pac1, pacapr, pace, pace4, paep, paf1, paf2, pafah, pafah1b1, pafah1b2, pafah1b3, paga, pah, pahx, pai1, pai2, paics, pak1, pak3, palb, pals, pam, pang, pap, papa, papa2, pappa, par1, par1, par2, par3, par4, par4, par5, park1, park2, park3, pawr, pax1, pax2, pax3, pax4, pax5, pax6, pax7, pax8, pax9, pbca, pbcra, pbfe, pbg pbt, pbx1, pbx2, pbx3, pc, pc1, pc2, pc3, pc3, pca1, pcad, pcap, pcar1, pcbc, pcbd, pcbp1, pcbp2, pcca, pccb, pcdh7, pcdx, pchc, pchc1, pci, pck1, pcl, pc1p, pcm1, pcm1, pcmt1, pcna, pcnt, pcolce, pcp, pcp4, pcs, pcsk1, pcsk2, pcsk3, pcsk4, pcsk5, pcsk6, pctk1, pctk3, pcyt1, pdb, pdb2, pdc, pdc, pdcd1, pdcd2, pddr, pde1a, pde1b, pde1b1, pde3b, pde4a, pde4b, pde4c, pde4d, pde5a, pde6a, pde6b, pde6c, pde6d, pde6g, pde6h, pde7a, pdea, pdea2, pdeb pdeb, pdeg, pdeslb, pdgb, pdgfa, pdgfb, pdgfr, pdgfra, pdgfrh, pdha1, pdha2, pdhb, pdj, pdk4, pdnp1, pdnp2, pdnp3, pdr, pds, pds1, pdx1, pdyn, pe1, pea15, pebp2a1, pebp2a3, pecam1, ped, ped, pedf, pee, peg1, peg3, pemp, penk, pent, peo, peo1, peo2, pepa, pepb, pepc, pepd, pepe, pepn, peps, per, pert, peta3, pets1, pex1, pex5, pex6, pex7, pf4, pf4v1, pfas, pfbi, pfc, pfd, pfhb1, pfic1, pfic2, pfkfb1, pfkfb2, pfk1, pfk-mn, pfkp, pfkx, pf1, pfm, pfn1, pfn2, pfrx, pga3, pga4, pga5, pgam1, pgam2, pgamm, pgc, pgd, pgf, pgf1, pgk1, pgk2, pgka, pg1, pg11, pg12, pgm1, pgm2, pgm3, pgm5, pgn, pgp, pgp1, pgr, pgs, pgt, pgy1, pgy3, pha1, pha2, pha2a, pha2b, phap1, phb, phc, phe1a, phe3, phex, phf1, phhi, phhi, phk, phka1, phka2, phkb, phkd, phkg1, phkg2, ph1, phl11, phog, phox1, phox2a, php, php1b, phpx, phyh, pi, pi10, pi3, pi4, pi5, pi6, pi7, pi8, pi9, piga, pigc, pigf, pigh, pigr, pik3c2b, pik3ca, pik3r1, pik4cb, pi1, pim1, pin, pin1, pin11, pip, pip5k1b, pir1, pir51, pit, pit1, pitpn, pitx1, pitx2, pitx3, pjs, pk1, pk120, pk3, pk428, pkca, pkcb, pkcc, pkcg, pkcs1, pkd1, pkd2, pkd4, pkdts, pkhd1, pklr, pkm2, pkp1, pks1, pks1, pks2, pku1, pl, pla2, pla2a, pla2b, pla2g1b, pla2g2a, pla2g4, pla2g4a, pla2g5, pla21, pla21, plag1, plag11, planh1, planh2, planh3, plat, plau, plaur, plb, plc, plc1, plcb3, plcb4, plcd1, plce, plcg1, plcg2, plc1, pld1, plec1, plg, plgf, plg1, pli, pln, plod, plod2, plos1, plp, pls, pls1, plt1, pltn, pltp, plzf, pmca1, pmca2, pmca3, pmca4, pmch, pmch11, pmch12, pmd, pme117, pmil, pm1, pmm1, pmm2, pmp2, pmp22, pmp35, pmp69, pmp70, pms1, pms2, pms11, pms12, pmx1, pn1, pnd, pnem, pnkd, pnlip, pnmt, pnoc, pod1, podx1, pof, pof1, pol2rb, pola, polb, pold1, pold2, pole, polg, polr2a, polr2c, polr2e, polr2g, polr2i, polrmt, polz, pomc, pon, pon1, pon2, pon3, por, porc, potx, pou1f1, pou2af1, pou3f1, pou3f2, pou3f3, pou3f4, pou4f1, pou4f3, pou5f1, pp, ppl4, pp2, pp4, pp5, ppac, ppard, pparg, pparg1, pparg2, ppat, pbp, ppcd, ppd, ppef1, ppef2, ppfia3, ppgb, pph, pph1, ppia, ppid, ppi11, ppkb, ppks1, ppks2, pp1, ppla2, ppmx, ppnd, ppnoc, ppo1, ppox, ppp1a, ppp1ca, ppp1cb, ppp1cc, ppp1r2, ppp1r5, ppp1r7, pppd1r8, ppp2b, ppp2ca, ppp2cb, ppp2r1b, ppp2r4, ppp2r5a, ppp2r5b, ppp2r5c, ppp2r5d, ppp2r5e, ppp3ca, ppp3cb, ppp3 cc, pp 3r1, ppp4c, ppp5c, ppt, ppt2, ppx, ppy, ppyr1, pr@, prad1, prb1, prb2, prb3, prb4, prca1, prca2, prcc, prcp, pre1p, prep, prf1, prg, prg1, prg1, prgs, prh1, prh2, prim1, prim2a, prim2b, prip, prk1, prkaa1, prkaa2, prkab1, prkaca, prkacb, prkacg, prkag1, prkag2, prkar1a, prkar1b, prkar2b, prkca, prkcb1, prkcd, prkcg, prkci, prkc11, prkcnh1, prkcq, prkcsh, prkdc, prkg1, prkg1b, prkg2, prkgr1b, prkgr2, prkm1, prkm3, prkm4, prkm9, prkn, prkr, prkx, prky, pr1, prlr, prm1, prm2, prmt2, prnp, proa, proc, prodh, prohb, prop1, pros1, pros30, prox1, prp8, prph, prps1, prps2, pipsap1, prr1, prr2, prs, prsc1, prss1, prss11, prss2, prss7, prss8, prss11, prtn3, prts, psa, psa, psach, psap, psbg1, psbg2, psc2, psc5, psca, psd, psen1, psen2, psf1, psf2, psg1, psg11, psg12, psg13, psg2, psg3, psg4, psg5, psg6, psg7, psg8, psg11, pskh1, psm, psma1, psma2, psma3, psma5, psmb1, psmb10, psmb2, psmb3, psmb4, psmb5, psmb8, psmb9, psmc1, psmc2, psmc3, psmc5, psmd7, psmd9, psmel, psme2, psors1, psors2, psors3, psp, psps1, psps2, pssl, psst, pst, pst, pst1, psti, ptafr, ptc, ptc, ptc, ptch, ptd, pten, ptgds, ptger1, ptger2, ptger3, ptgfr, ptgfrn, ptgir, ptgs1, ptgs2, pth, pth1h, pthr, pthr1, pthr2, ptk1, ptk2, ptk2b, ptk3, ptk7, ptlah, ptma, ptms, ptn, ptos1, ptp18, ptp1b, ptp4a1, ptp4a2, ptpa, ptpa, ptpd, ptpg, ptpg1, ptpgmc1, ptpn1, ptpn10, ptpn11, ptpn 12, ptpn13, ptpn14, ptpn2, ptpn5, ptpn6, ptpn7, ptpra, ptprb, ptprc, ptprcap, ptprd, ptpre, ptprf, ptprg, ptprh, ptprj, ptprk, ptpr11, ptpr12, ptprm, ptprn, ptpro, ptprs, ptprz1, ptpt, pts, pts1r, ptx1, ptx3, pujo, pum, pur1, pur1, pura, pva1b, pvr, pvr11, pvr12, pvrr1, pvrr2, pvs, pvt1, pwcr, pwp2, pwp2h, pws, pxaaa1, pxe, pxe1, pxf, pxmp1, pxmp11, pxmp3, pxr1, pycr1, pycs, pygb, pyg1, pygm, pyk2, pyst1, pyst2, pzp, gars, qdpr, qin, qm, qpc, qprs, rab, rab1, rab13, rab1a, rab21, rab3a, rab3b, rab4, rab5, rab5a, rab6, rab7, rabgd1a, rabgd1b, rabggta, rabggtb, rabif, rac2, rac3, rad1, rad17, rad23a, rad23b, rad51a, rad51c, rad51d, rad5311, rad52, rad54, rad6a, rad6b, raf1, rafa1, rag1, rag2, rage, ra1a, ra1b, ralgds, ramp, ranbp211, ranbp3, rao, rap1a, rap1b, rap1ga1, rap1gds1, rap2a, rap74, rapsn, rara, rarb, rarg, rars, rasa1, rasa2, rasgfr3, rask2, rb1, rbbp2, rbbp5, rbbp6, rb11, rb12, rbm1, rbm2, rbm3, rbmy1a1, rbp1, rbp2, rbp3, rbp4, rbp5, rbp56, rbp6, rbq3, rbtn1, rbtn11, rbtn12, rca1, rcac@, rcc1, rccp1, rccp2, rcd1, rcd2, rcdp1, rcn1, rcn2, rcp, rcv1, rd, rdbp, rdc7, rdp, rdpa, rdrc, rds, rdt, rdx, reca, recc1, recq1, red1, red2, reg, reg1a, reg1, re1, rela, rein, ren, renbp, rent1, rent1, rep8, req, ret, rev3, rev31, rfc1, rfc2, rfc3, rfc4, rfc5, rfp, rfx1, rfx2, rfx5, rfxank, rfxap, rgc1, rgr, rgs, rgs1, rgs14, rgs16, rgs2, rgs2, rgs3, rgs5, rh50a, rhag, rhbd1, rhc, rhce, rhd, rheb2, rho, rho7, rhogap2, rhogap3, rhoh12, rhoh6, rhoh9, rhok, rhom1, rhom2, rhom3, rieg1, rieg2, rige, rigui, ring1, ring10, ring11, ring12, ring3, ring31, ring4, ring5, ring6, ring7, rip, rip140, riz, rk, r1, rlbp1, rlf, rln1, rln2, rmch1, rmd1, rmrp, rmrpr, rn5s1@, rnase1, rnase2, rnase3, rnase4, rnase5, rnase6, rnase1, rnaseli, rne1, rnf1, rnf3, rnf4, rnf5, rnh, rnpep, rnpulz, rnr1, rnr2, rnr3, rnr4, rnr5, rns1, rns2, rns3, rns4, rns4, rns4i, rntmi, rnu1, rnu15a, rnu17a, rnu17b, rnu1a, rnu2, rnu3, ro52, rom1, romk1, ron, ror1, rora, rorb, rorc, rorg, ros1, rosp1, rox, rp1, rp10, rp105, rp11, rp12, rp13, rp14, rp15, rp17, rp18, rp19, rp2, rp22, rp24, rp25, rp3, rp4, rp6, rp7, rp9, rpa1, rpa2, rpa3, rpd311, rpe, rpe65, rpe119rp122, rp123a, rp1231, rp129, rp130, rp135a, rp136a, rp17a, rpms12, rpn1, rpn2, rpo12, rps11, rps14, rps17, rps17a, rps17b, rps1711, rps1712, rps18, rps20a, rps20b, rps24, rps25, rps3, rps4x, rps4y, rps6, rps6ka1, rps6ka2, rps6ka3, rps8, rpsm12, rptpm, rpu1, rpx, rrad, rras, rrbp1, rreb1, rrm1, rrm2, rrp, rrp22, rs1, rs1, rscla1, rsk1, rsk2, rsk3, rsn, rss, rsts, rsu1, rt6, rtef1, rtkn, rtn1, rtn2, rts, rts, rtt, rws, rxra, rub, rxrg, ryr1, ryr2, ryr3, rzrb, rzrg, s100a1, s100a10, s100a11, s100a12, s100a13, s100a2, s100a3, s100a4, s100a5, s100a6, s100a7, s100a8, s100a9, s100b, s100d, s100e, s100, s100p, s152, s4, s7, saa1, saa2, saa4, sacs, safb, sag, sah, sahh, sai1, sakap84, sal11, sal12, sams1, sams2, sap, sap1, sap1, sap2, sap62, sar, sar1, sar2, sard, sas, sat, satb1, sat, sbma, sc, sc1, sc5d1, sca1, sca10, sca2, sca2, sca3, sca4, sca5, sca6, sca7, sca8, sca8, scar, scca1, scca2, sccd, scd, sceh, scg1, scg2, scg3, schad, scida, scidx, scidx1, scl, sclc1, scl1, scn, scn1a, scn1b, scn2a, scn2a1, scn2a2, scn2b, scn3a, scn4a, scn5a, scn6a, scn8a, scnn1a, scnn1b, scnn1d, scnn1g, scot, scp, scp1, scp2, scpn, scra1, scra1, scs, sctr, scya1, scya11, scya13, scya14, scya15, scya16, scya19, scya2, scya21, scya22, scya24, scya25, scya3, scya311, scya4, scya5, scya7, scya8, scyb5, scyb6, scyd1, sczd1, sczd2, sczd3, sczd4, sczd5, sczd6, sczd7, sczd8, sdc1, sdc2, sdc4, sdf1, sdf2, sdh1, sdh2, sdha, sdhb, sdhc, sdhd, sdhf, sds22, sdty3, sdys, se, sea, sec1311, secl3r, sec 141, sec7, sed1, sedt, sef2, sel11, sele, sel1, selp, selp1g, sema3f, sema4, sema5, semg, semg1, semg2, sent, sep, sepp1, serca1, serca3, serk1, ses1, set, sex, sf, sf1, sfa1, sfd, sfmd, sfrs1, sfrs2, sfrs7, sftb3, sftp1, sftp2, sftp4, sftpa1, sftpa2, sftpb, sftpc, sftpd, sgb, sgca, sgcb, sgcd, sgcg, sgd, sgk, sglt1, sg1t2, sgm1, sgne1, sgp2, sgpa, sgsh, sh2d1a, sh3 bp2, sh3d1a, sh3gbr, sh3p17, shb, shbg, shc1, shc11, shfd1, shfd2, shfm1, shfm2, shfm3, shh, ship, shmt1, shmt2, shoc2, shot, shox, shox2, shps1, shs, shsf1, si, siah1, siah2, siasd, siat1, siat4, siat4c, siat8, sids, si1, silv, sim1, sim2, sipa1, sis, siv, six1, six5, sja, sjs, ski, ski2, ski2w, skiv21, skp1a, skp1b, skp2, sla, slap, slbp, slc, slc10a1, slc10a2, slc12a1, slc12a2, slc12a3, slc14a1, slc14a2, slc15a1, slc16a1, slc16a2, slcl7a1, slc17a2, slc18a1, slc18a2, slc18a3, slc19a1, slcla1, slc1a2, slc1a3, slc1a4, slc1a5, slc20a1, slc20a2, slc20a3, slc21a2, slc21a3, slc22a1, slc22a2, slc22a5, slc2a1, slc2a2, slc2a3, slc2a4, slc2a5, slc2c, slc3a1, slc4a1, slc4a2, slc4a6, slc5a1, slc5a2, slc5a3, slc5a5, slc6a1, slc6a10, slc6a12, slc6a4 slc6a3, slc6a4, slc6a6, slc6a8, slc6a9, slc7a1, slc7a2, slc7a4, slc7a5, slc7a7, slc8a1, slc8a2, slc9a1, slc9a2, slc9a3, slc9a4, slc9a5, sld, sle1, sleb1, slim1, sln, slo, slos, slp76, sls, slug, sm1, sm22, sma4, smad1, smad1, smad2, smad3, smad4, smad5, smad6, smad7, smad9, sma1, smam1, smarca1, smarca2, smarca3, smarca5, smarcb1, smax2, smc1, smcc, smcr, smcx, smcy, sml1, smn, smn 1, smn2, smnr, smo, smoh, smnd 1, sms, smt3, smt3h1, smtn, smubp2, sn, snap25, snat, snca, sncb, sncg, snf2h, snf211, snf212, snf213, snf5, sn1, snn, snrp70, snrpa, snipe, snrpn, sntl, snt2b1, snt2b2, sntb1, snt1, snx, soat, sod1, sod2, sod3, solh, son, sord, sor11, sos1, sos2, sox1, sox10, sox11, sox2, sox20, sox22, sox3, sox4, sox9, sp1, sp1, sp3, sp3, sp4, spa1, spag1, spag4, spam1, Sparc, spat, spbp, spch1, spd, spf30, spg3a, spg4, spg5a, spg6, spg7, spg8, spg9, spgp, spgy1a, sph2, spi1, spink1, spk, spmd, spn, spp1, spp2, sppm, spr, sprk, sprr1a, sprr1b, sprr2a, sprr2b, sprr2c, sprr3, sps1, spsma, spta1, sptan1, sptb, sptbn1, sra1, sra2, src, src1, src1, src2, srd5a1, srd5a2, srebf1, srebf2, sri, srk, srm, srn1, srp14, srpl9, srp46, srpr, srpx, srs, srvx, sly, ss, ss, ssa, ssa1, ssa2, ssadh, ssav1, ssbp, ssdd, ssr2, ssrc, sst, sstr1, sstr2, sstr3, sstr4, sstr5, ssx1, ssxt, st2, st3, st4, st5, st6, st8, sta, stac, stam, star, stat, stat1, stat3, stat4, stat5, ssx1, stc1, stch, std, std, step, step, stf1, stfa, stfb, stgd1, stgd2, stgd3, stgd4, sthe, stk1, stk11, stk15, stk2, stk6, st1, stm, stm2, stm7, stmy1, stmy2, stmy3, stp, stp1, stp2, sts, sts1, stx, stx1b, stx7, stxbp1, stxbp2, sultlc1, supt6h, sur, sur1, surf1, surf2, surf3, surf4, surf5, surf6, svct2, svmt, sw, sxi2, syb1, syb2, syb11, sycp1, syk, sym1, syn1, syn2, syn3, syngap, syns1, syp, syt, syt1, syt2, syt3, syt4, syt5, t, t3d, taa16, tac1r, tac2, tac2r, tac3, tacrl, tacr2, taf2, taf2a, taf2a, taf2d, taf2h, taf2n, tafii100, tagln, tak1, tal1, tal2, taldo1, tam, tan1, tap1, tap2, tapa1, tapbp, tapvr1, tars, tas, task, tat, taut, tax, tax1, taz, tbg, tbp, tbp1, tbs, tbx1, tbx2, tbx3, tbx5, tbxa2r, tbxas1, tc1, tc2, tcbp, tcd, tcea1, tceb11, tceb3, tcf1, tcf12, tcf13, tcf1311, tcf14, tcf15, tcf17, tcf19, tcf2, tcf20, tcf21, tcf3, tcf4, tcf5, tcf611, tcf612, tcf7, tcf8, tcf9, tcfeb, tcf11, tcf14, tcl1, tcl1a, tcl2, tcl3, tcl4, tcl5, tcn1, tcn2, tco, tcof1, tcp1, tcp10, tcp11, tcp228, tcpt, tcra, tcrb, tcrd, tcrg, tcrz, tcs1, tcta, tcte1, tcte3, tcte11, tdf, tdfa, tdfx, tdg, tdgf1, tdn, tdo, tdo2, tdt, tead4, tee, tee, teck, tecta, tef, tegt, tek, te1, tem, tep1, terc, terf1, tert, tes1, teskl, tex28, tf, tf2s, tf6, tfa, tfam, tfap2a, tfap2b, tfap2c, tfap4, tfcoup1, tfcoup2, tfcp2, tfdp1, tfdp2, tfe3, tff1, tff2, tff3, tfiiia, tfn, tfpi, tfpi2, tfr, tfrc, tfs1, tft, tg, tg737, tgb1, tgb2, tgd, tgfa, tgfb1, tgfb2, tgfb3, tgfb4, tgfbi, tgfbr1, tgfbr2, tgfbr3, tgfbre, tgfr, tgm1, tgm2, tgm3, tgm4, tgn38, tgn46, th, thas, thbd, thbp1, thbs1, thbs2, thbs3, thc, thh, th1, thop1, thpo, thr1, thra, thra1, thra1, thrb, thrm, thrsp, thy1, tial1, tiam1, tiar, tic, tie, tie1, tie2, tigr, ti1, til3, til4, tim, time, timp1, timp2, timp3, tinur, titf1, titf2, tip1, tk1, tk2, tkc, tkcr, tkr, tkt, tkt2, tkt11, tla519, tlcn, tle1, tie2, tie3, tlh1, tln, tlr1, tlr2, tlr3, tlr4, tlr5, tm4sf1, tm4sf2, tm7sf2, tmc, tmd, tmdci, tmem1, tmf1, tmip, tmod, tmp, tmpo, tmprss2, tms, tmsa, tmsb, tmvcf, tna, tndm, tnf, tnfa, tnfaip1, tnfaip2, tnfaip4, tnfaip6, tnfar, tnfb, tnfbr, tnfc, tnfcr, tnfr1, tnfr2, tnfrsf10b, tnfrsf12, tnfrsf14, tnfrsf16, tnfrsf17, tnfrcf1a, tnfrsf1b, tnfrsf4, tnfrsf5, tnfrsf6, tnfrsf6b, tnfrsf7, tnfrsf8, tnfrsf9, tnfsfl 1, tnfsf12, tnfsf5, tnfsf6, tnfsf7, tnnc1, tnnc2, tnnil, tnni2, tnni3, tnnt1, tnnt2, tnnt3, tnp1, tnp2, tnr, tns, tnx, tnxa, toe, top1, top2, top2a, top2b, top3, tp1, tp120, tp250, tp53, tp53 bp2, tp63, tp73, tpa, tpbg, tpc, tpc, tph, tph2, tpi1, tp12, tpm1, tpm2, tpm3, tpm4, tpmt, tpo, tpo, tpp2, tpr, tpr1, tprd, tps1, tps2, tpsn, tpst1, tpst2, tpt, tpt1, tptps, tpx, tpx1, tr, tr2, tr4, tra1, trafl, traf5, trailr2, tran, trance, trap170, trc3, trc8, tre, treb36, trek, trfl, trg1, trh, trhr, tric5, trio, trip1, trip14, trip6, trk, trk1, trka, trkb, trkc, trke, trl1, trl2, trm1, trm1, trm2, trma, trmi1, trmi2, trn, trn1, tro, trp1, trp1, trp2, trp3, trpc1, trpm2, trpo, trps1, trps2, trq1, trr, trr3, trrap, trsp, trt1, trt2, trv1, trv2, trv3, trv4, trv5, try1, try2, ts, ts13, ts546, tsbn51, tsc tsc1, tsc2, tsd, tse1, tsg101, tsg7, tshb, tshr, tsix, tsp3, tspy, tssc3, tst1, tst1, tsta3, tsy, ttc1, ttc3, ttf, ttf1, ttf2, ttg2, ttim1, ttn, ttp, ttpl, ttpa, ttr, tuba3, tuball, tubb, tufm, tuft1, tulp1, tuple1, tw, tweak, twik1, twist, txgpl1, txk, txn, txnr, txnrdl, tyh, tyk1, tyk2, tyk3, tyms, tyr, tyr1, tyro3, tyrp1, tyrp2, tys, ul7hg, ulrnp, u22hg, u2af1, u2aflrs1, u2aflrs2, u2aflrs3, uba52, ubb, ubc, ubc4, ubc7, ubc8, ubch2, ubc1, ube1, ube2, ube2a, ube2b, ube2e2, ube2g, ube2g2, ube2h, ube21, ube211, ube2v1, ube3a, ubh1, ubid4, ub11, uch11, ucn, ucp1, ucp2, ucp3, udpgdh, uev1, ufd11, ufs, ugalt, ugb, ugcg, ugdh, ugn, ugp1, ugp2, ugpp2, ugt1, ugt1a1, ugt2b11, ugt2b15, ugt2b17, ugt2b4, ugt2b7, ugt2b8, ugt2b9, ugt1, uhg, uhx1, ukhc, umod, umph2, umpk, umps, unc18, uncl8b, und, ung, unr, unr, uox, up, upk1b, ups, uqbp, uqcrb, uqcrc1, uqcrc2, uqcrfs1, uqor1, uqor13, uqor22, urk, urkr, uroc, urod, uros, usf1, usf2, ush1, ush1a, ush1b, ush1c, ush1d, ush1e, ush1f, ush2a, ush3, uspl 1, usp5, usp7, usp9x, usp9y, ut1, ut2, ute, utr, utrn, utx, uty, uv20, uv24, uvo, yacht, vacm1, vamp1, vamp2, vars1, vasp, vat1, vat2, vav, vav1, vav2, vbch, vbp1, vcam1, vcf, vc1, vcp, vdac1, vdac2, vdd1, vdi, vdr, vegf, vegfb, vegfd, vegfr3, vgf, vg1, vgr1, vh1, vhr, vill, vil2, vim, vip, vipr1, vipr2, vis1, via1, vla5a, vlacs, vlcad, vldlr, vmat1, vmcm, vmd1, vmd2, vnra, vnt, vp, vpp1, vpp3, vpreb1, vpreb2, vrf, vrk1, vrk2, vrnf, vrni, vsn11, vtn, vwf, vws, wafl, wars, was, wbs, wd1, wdr2, wee1, wfrs, wfs, wfs1, wgn1, whcr, wi, wisp1, wisp2, wisp3, wnd, wnt1, wnt10b, wnt13, wnt14, wnt15, wnt2, wnt3, wnt5a, wnt7a, wnt7b, wnt8b, wrb, wrn, ws1, ws2a, ws2b, ws4, wsn, wss, wss, wt1, wt2, wt3, wt4, wt5, wts, wts1, wws, x11, xbp1, xbp2, xce, xdh, xe169, xe7, xe7y, xg, xgr, xh2, xiap, xic, xist, xk, xla, xla2, xlp, xlpd, xlrs1, xm, xpa, xpb, xpc, xpcc, xpct, xpf, xpf, xpg, xpmc2h, xpnpep2, xpo1, xrcc1, xrcc2, xrcc3, xrcc4, xrcc5, xrcc9, xrs, xs, xwnt2, yb1, yes1, yk140, y11, yrrm1, yt, ywha1, ywhab, ywhah, ywhaz, yy1, zac, zag, zan, zap70, zf87, zfm1, zfp3, zfp36, zfp37, zfx, zfy, zic1, zic2, zic3, zipk, znfl, znf10, znf117, znf11a, znf11b, znf12, znf121, znf123, znf124, znf125, znf126, znf13, znf14, znf141, znf144, znf146, znf147, znf157, znf16, znf160, znf162, znf163, znf165, znf169, znf173, znf179, znf189, znf19, znf192, znf193, znf195, znf198, znf2, znf20, znf200, znf204, znf217, znf22, znf23, znf24, znf25, znf26, znf27, znf29, znf3, znf32, znf34, znf35, znf36, znf38, znf4, znf40, znf41, znf42, znf44, znf45, znf46, znf5, znf6, znf69, znf7, znf70, znf71, znf72, znf73, znf74, znf75, znf75a, znf75c, znf76, znf77, znf79, znf8, zn80, znf81, znf83, znf9, znfc150, znfc25, znfxy, znt3, znt4, zp3a, zp3b, zpk, zwsl, and zyx.

Furthermore, genes from bacteria, plants, yeast, and mammals (e.g., mice) can be used with the microorganisms provided herein. Non-limiting examples of *E. coli* genes include: aarF, aas, aat, abpS, abs, accA, accB, accC, accD, acd, aceA, aceB, aceE, aceF, aceK, ackA, ackB, acnA, acnB, acpD, acpP, acpS, acpX, acrA, acrB, acrC, acrD, acrE, acrF, acrR, acs, ada, add, adhB, adhC, adhE, adhR, adiA, adiY, adk, aegA, aer, aes, agaA, agaB, agaC, agaD, agaI, agaR, agaS, agaV, agaW, agaZ, agp, ahpC, ahpF, aidB, ais, alaS, alaT, alaU, alaV, alaW, alaX, aldA, aldB, aldH, alkA, atkB, alpA, alr, alsA, aisB, alsC, alsE, alsK, alx, amiA, amiB, amn, ampC, ampD, ampE, ampG, ampH, amtB, amyA, ansA, ansB, apaG, apaH, aphA, appA, appB, appC, appY, apt, aqpZ, araA, araB, araC, araD, araE, araF, araG, araH, araJ, arcA, arcB, argA, argB, argC, argD, argE, argF, argG, argH, argI, argM, argP, argQ, argR, argS, argT, argU, argV, argW, argX, argY, argZ, aroA, aroB, aroC, aroD, aroE, aroF, aroG, aroH, aroI, aroK, aroL, aroM, aroP, aroT, arsB, arsC, arsR, artI, artJ, artM, artP, artQ, ascB, ascF, ascG, asd, aslA, aslB, asmA, asnA, asnB, asnC, asnS, asnT, asnU, asnV, asnW, aspA, aspC, aspS, aspT, aspU, aspV, asr, asu, atoA, atoB, atoC, atoD, atoS, atpA, atpB, atpC, atpD, atpE, atpF, atpG, atpH, atpI, avtA, azaA, azaB, azl, bacA, baeR, baeS, barA, basR, basS, bax, bcp, bcr, betA, betB, betI, betT, bfd, bfm, bfr, bglA, bglB, bglF, bglG, bglJ, bglT, bglX, bioA, bioB, bioC, bioD, bioF, bioH, bioP, bipA, birA, bisC, bisZ, blc, bolA, bRNQ, brnR, brnS brnT, btuB, btuc, btuD, btuE, btuR, bymA, cadA, cadB, cadC, cafA, caiA, caiB, caiC, caiD, caiE, caiF, caiT, calA, caiC, calD, can, carA, carB, cbl, cbpA, cbt, cca, ccmA, ccmB, ccmC, ccmD, ccmE, ccmF, ccmG, ccmH, cdd, cde, cdh, cdsA, cdsS, cedA, celA, celB, celC, celD, celF, cfa, cfcA, chaA, chaB, chaC, cheA, cheB, cheR, cheW, cheY, cheZ, chpA, chpB, chpR, chpS, cirA, citA, citB, cld, cipA, clpB, clpP, clpX, cls, cmk, cmlA, cmr, cmtA, cmtB, coaA, cobS, cobT, cobU, codA, codB, cof, cog?, corA, cpdA, cpdB, cpsA, cpsB, cpsC, cpsD, cpsE, cpsF, cpsG, cpxA, cpxB, cpxP, cpxR, creA, creB, creA, creB, creC, creD, crg, crl, crp, crr, csdA, csgA, csgB, csgD, csgE, csgF, csgG, csiA, csiB, csiC, csiD, csiE, csiF, cspA, cspB, cspC, cspD, cspE, cspG, csrA, csrB, cstA, cstC, cup, cutA, cutC, cutE, cutF, cvaA(ColV), cvaB(ColV), cvaC(ColV), cvi(ColV), cvpA, cxm, cyaA, cybB, cybC, cycA, cydA, cydB, cydC, cydD, cynR, cynS, cynT, cynX, cyoA, cyoB, cyoC, cyoD, cyoE, cysA, cysB, cysC, cysD, cysE, cysG, cysH, cyst, cyst, cysK, cysM, cysN, cysP, cysQ, cysS, cysT, cysU, cysW, cysX?, cysZ?, cytR, dacA, dacB, dacC, dacD, dadA, dadB, dadQ, dadX, dam, dapA, dapB, dapD, dapE, dapF, dbpA, dcd, dcm, dcp, dcrB, dctA, dctB, dcuA, dcuB, dcuC, ddlA, ddlB, ddpA, ddpB, ddpC, ddpD, ddpF, ddpX, deaD, dedA, dedD, def, degP, degQ, degS, del, deoA, deoB, deoC, deoD, deoR, dfp, dgd, dgkA, dgkR, dgoA, dgoD, dgoK, dgoR, dgoT, dgsA, dgt, dicA, dicB, dicC, dicF, dinB, dinD, dinF, dinG, dinI, dinY, dipZ, djlA, dksA, dld, dmsA, dmsB, dmsC, dnaA, dnaB, dnaC, dnaE, dnaG, dnaI, dnaJ, dnaK, dnaL, dnaN, dnaQ, dnaT, dnaX, dppA, dppB, dppC, dppD, dppF, dppG, dps, dsbA, dsbB, dsbC, dsbG, dsdA, dsdC, dsdX, dsrA, dsrB, dut, dvl, dxs, ebgA, ebgB, ebgC, ebgR, ecfa, eco, ecpD, eda, edd, efp, enirA, emrB, emrD, emrE, endA, eno, entA, entB, entC, entD, entE, entF, envN envP, envQ, envR, envT, envY, envZ, epd, EppA, minigene, EppB, minigene, EppC, minigene, EppD, minigene, EppE, minigene, EppG, minigene, EppH, minigene, era, esp, evgA, evgS, exbB, exbC, exbD, expA, exuR, exuT, fabA, fabB, fabD, fabF, fabG, fabH, fabI, fabZ, fadA, fadB, fadD, fadE, fadH, fadL, fadR, farR, fatA, fbaA, fbaB, fbp, fcl, fcsA, fdhD, fdhE, fdhF, fdnG, fdnH, fdnI, fdoG, fdoH, fdoI, fdrA, fdx, feaB, feaR, fecA, fecB, fecC, fecD, fecE, fed, fecR, feoA, feoB, fepA, fepB, fepC, fepD, fepE, fepG, fes, fexB, ffh, ffs, fhlA, fhlB, fhuA, fhuB, fhuD, fhuE, fhuF, fic, fimA, fimB, fimC, fimD, fimE, fimF, fimG, fimH, fiml, fipB, fipC, fis, fiu, fixA, fixB, fixC, fixX, fklB, fkpA, fldA, flgA, flgB, flgC, flgD, flgE, flgF, flgG, flgH, flgI, flgJ, flgK, flgL, flgM, flgN, flhA, flhB, flhc, flhD, fliA, fliC, fliD, fliE, fliF, fliG, fliH, fliI, fliJ, fliK, flit, fliM, fliN, fliO, flip, fliQ, fliR, fliS, fliT, fliY, fliZ, flk, flu, fmt, fnr, focA, focB, folA, folC, folD, folE, folK, folP, folX, fpr, frdA, frdB, frdC, frdD, frr, fruA, fruB, fruK, fruR, fsr, fin, ftsA, ftsE, ftsI, ftsJ, ftsK, ftsL, ftsN, ftsQ, ftsW, ftsX, ftsY, ftsZ, fucA, fucI, fucK, fucO, fucP, fucR, fumA, fumB, fumC, fur, fusA, fusB, gabC gabD, gabP, gabT, gadA, gadB, gadR, galE, galF, galK, galM, galP, gaiR, galS, galT, galU, gapA, gapC, garA, garB, gatA, gatB, gatC, gatD, gatR, gatY, gatZ, gcd, gcl, gcpE, gcvA, gcvH, gcvP, gcvR, gcvT, gdhA, gef, ggt, gidA, gidB, gip, glcB, glcC, glcD, glcE, glcG, gldA, glf, glgA, glgB, glgC, glgP, glgS, glgX, glk glmM, glmS, glmU, glmX, glnA, glnB, glnD, glnE, glnG, glnH, glnK, glhL, glnP, glnQ, glnR, glnS, glnT, glnU, glnV, glnW, glnX, gloA, gipA, glpB, glpC, glpD, gipE, gipF, gipG, glpK, gipQ, gipR, glpT, glpX, gltA, gltB, gitD, gltE, gltF, gltH, gltJ, gltK, gltL, gitM, gltP, gltR, gItS, gltT, gltU, gltv, gltW, gltX, glyA, glyQ, glyS, glyT, glyU, glyv, glyW, glyX, glyY, gmd, gmk, gmm, gnd, gntK, gntP, gntR, gntS, gntT, gntU, gntV, goaG, gor, gph, gpmA, gpp, gprA, gprB, gpsA, gpt, greA, greB, groL, groS, grpE, grxA, grxB, grxC, gshA, gshB, gsk, gsp, gsp*, gst, guaA, guaB, guaC, gurB, gurC, gutM, gutQ, gyrA, gyrB, hcaB, hcaC, hcaD, hcaE, hcaF, hcaR, hcaT, hdeA, hdeB, hdeD, hdhA, helD, hemA, hemB, hemC, hemD, hemE, hemF, hemG, hemH, hemK, hemL, hemM, hemX, hemY, hepA, het, hflB, hflC, hflK, hflX, hfq, hha, hipA, hipB, hisA, hisB, hisC, hisD, hisF, hisG, hisH, hisI, hisJ, hisM, hisP, hisQ, hisR, hisS, hipA, hlyE, hmp, hns, holA, holB, holC, holD, holE, hopB, hopC, hopD, hpt, hrpA, hrpB, hrsA, hscA, hscB, hsdM, hsdR, hsdS, hsIC, hslD?, hsIE-H, hslJ, hslK, hsIL-N, hsIO-R, hsIU, hstV, hslW, htgA, htpG, htpX, htrB, htrC, htrE, htrL, hupA, hupB, hyaA, hyaB, hyaC, hyaD, hyaE, hyaF, hybA, hybB, hybC, hybD, hybE, hybF, hybG, hycA, hycB, hycC, hycD, hycE, hycF, hycG, hycH, hycI, hydA, hydG, hydH, hydN, hyfA, hyfB, hyfC, hyfD, hyfE, hyfF, hyfG, hyfH, hyfI, hyfJ, hyfR, hypA, hypB, hypC, hypD, hypE, hypF, iadA, iap, ibpA, ibpB, icd, iclR, ihfA, ihfB, ileR, ileS, ileT, ileU, ileV, ileX, ileY, ilvA, ilvB, ilvC, ilvD, ilvE, ilvF, ilvG, ilvH, ilyl, ilvJ ilvM, ilvN, ilvR, ilvU, ilvY, imp, inaA, inaR?, infA, infB, infC, inm, insA(IS1), intA, isb(IS1), isfA, ispA, ispB, KanR, katE, katG, kba, kbl, kch, kdgK, kdgR, kdgT, kdpA, kdpB, kdpC, kdpD, kdpE, kdpF, kdsA, kdsB, kdtA, kdtB, kefB, kefC, kgtp, ksgA, ksgB, ksgC, ksgD, lacA, lacI, lacY, lacZ, lamB, lar, ldcC, ldhA, lepA, lepB, leuA, leuB, leuC, leuD, leuJ, leuO, leuP, leuQ, leuR, leuS, leuT, leuU, leuV, leuW, leuX, leuY, leuZ, lev, lexA, lgt, lhr, ligA, ligT, linB, lipA, lipB, lit, livF, livG, livH, livJ, livK, livM, lldD, lldP, lldR, lolA, lon, lpcA, lpcB, lpd, lplA, lpp, lpxA, lpxB, lpxC, lpxD, lpxK, lrb, lrhA, lrp, lrs lspA, lysA, lysC, lysP, lysQ, lysR, lysS, lysT, lysU, lysV, lysW, lysX, lysY, lysZ, lytA, lytB, lyx, maa, mac, mae, mafA, mafB, malE, malF, malG, malI, malK, malM, malP, malQ, malS, malT, malX, malY, malZ, manA, manC, manX, manY, manZ, map, marA, marB, marR, mbrB, mcrA, mcrB, mcrC, mcrD, mdaB, mdh, mdoB, mdoG, mdoH, meb, melA, melB, melR, menA, menB, menC, menD, menE, menF, mepA, mesJ, metA, metB, metC, metD, metE, metF, metG, metH, metJ, metK, metL, metR, metT, metU, metV, metW, metY, metZ, mfd, mgIA, mglB, mglC, mglR, mgsA, mgtA, mhpA, mhpR, mhpC, mhpD, mhpF, mhpP, mhpR, miaA, miaD, micF, minC, minD, minE, mioC, mltA, mltB, mltC, mltD, mmrA(rhlB?), mng, mntA, moaA, moaB, moaC, moaD, moaE, mobA, mobB, moc, modA, modB, modC, modE, modF, moeA, moeB, mog, molR, motA, motB, mpl, mppA, mprA, mraA—?, mraY, mrcA, mrcB, mrdA, mrdB, mreB, mreC, mreD, mrp, mrr, msbA, msbB, mscL, msrA, msyB, mtg, mtgA, mtlA, mtlD, mtlR, mtr, mttA, mttB, mttC, mukB, mukE, mukF, mul, murA, murB, murC, murD, murE, murF, murG, murH, murI, mutG, mutH, mutL, mutM, mutS, mutT, mutY, nac, nadA, nadB, nadC, nadE, nagA, nagB, nagC, nagD, nagE, nalB, nalD, nanA, nanE, nanK, nanR, nanT, napA, napB, napC, napD, napF, napG, napH, narG, narH, narI, narJ, narK, narL, narP, narQ, narU, narV, narW, narX, narY, narZ, ndh, ndk, neaB, nei, nemA, nfi, nfnA, nfnB, nfo, nfrA, nfrB, nfrD, nfsA, nhaA, nhaB, nhaR, nikA, nikB, nikC, nikD, nikE, nirB, nirC, nirD, nlpA, nlpB, nlpC, nlpD, nmpC(qsr'), non, npr, nrdA, nrdB, nrdD, nrdE, nrdF, nrdG, nrfA, nrfB, nrfC, nrfD, nrfE, nrfF, nrfG, nth, ntpA, nuoA, nuoB, nuoC, nuoE, nuoF, nuoG, nuoH, nuoI, nuoJ, nuoK, nuoL, nuoM, nuoN, nupC, nupG, nusA, nusB, nusG, nuvA, nuvC, ogrK, ogt, ompA, ompC, ompF, ompG, ompR, ompT, ompX, oppA, oppB, oppC, oppD, oppE, oppF, opr, ops, oraA, ordL, orf-23(purB, reg)orfl95(nikA-reg), orn, osmB, osmC, osmE, osmY, otsA, otsB, oxyR, oxyS, pabA, pabB, pabC, pac, pal, panB, panC, panD, panF, parC, parE, pat, pbpG, pck, pcm, pcnB, pdhR, pdxA, pdxB, pdxH, pdxJ, pdxK, pdxL, pdxY, pepA, pepD, pepE, pepN, pepP, pepQ, pepT, pfkA, pfkB, pflA, pflB, pflC, pflD, pfs, pgi, pgk, pgl, pgm, pgpA, pgpB, pgsA, pheA, pheP, pheS, pheT, pheU, pheV, phnC, phnD, phnE, phnF, phnG, phnH, phnI, phnJ, phnK, phnL, phnM, phnN, phnO, phnP, phoA, phoB, phoE, phoH, phoP, phoQ, phoR, phoU, phrB, phxB, pin, pioO, pit, pldA, pldB, plsB, plsC, plsX, pmbA, pncA, pncB, pnp, pntA, pntB, pnuC, poaR, polA, polB, popD, potA, potB, potC, potD, potE, potF, potG, potH, potI, poxA, poxB, ppa, ppc, pphA, pphB, ppiA, ppiB, ppiC, ppk, pppA, pps, ppx, pqiA, pqiB, pqqL, pqqM, prc, prfA, prfB, prfC, priA, priB, priC, pricC, prlZ, prmA, prmB, proA, proB, proC, proK, proL, proM, prop, proQ, proS, proT, proV, proW, proX, prpA, prpC, prpR, prr, prs, psd, psiF, pspA, pspB, pspC, pspE, pspF, pssA, pssR, pstA, pstB, pstC, pstS, psu, pta, pth, ptrA, ptrB, ptsG, ptsH, ptsI, ptsN"-", ptsP, purA, purB, purC, purD, purE, purF, purH, purK, purL, purM, purN, purP, purR, purT, purU, pus, putA, putP, pykA, pykF, pyrB, pyrC, pyrD, pyrE, pyrF, pyrG, pyrH, pyrI, qmeC, qmeD, qmeE, qor, queA, racC, racR, radA, radC, ranA, rarD, ras, rbfA, rbn, rbsA, rbsB, rbsC, rbsD, rbsK, rbsR, rcsA, rcsB, rcsC, rcsF, rdgA, rdgB, recA, recB, recC, recD, recE, recF, recG, recJ, recN, recO, recQ, recR, recT, relA, relB, relE, relF, relX, rep, rer, rfaB, rfaC, rfaD, rfaF, rfaG, rfaH, rfaI, rfaJ, rfaK, rfaL, rfaP, rfaQ, rfaS, rfaY, rfaZ, rfbA, rfbB, rfbC, rfbD, rfbX, rfc, rfe, rffA, rffC, rffD, rffE, rffG, rffH, rffM, rffT, rhaA, rhaB, rhaD, rhaR, rhaS, rhaT, rhlB, rhlE, rho, ribA, ribB, ribC, ribD, ribE, ribF, ridA, ridB, rimA, rimC, rimD, rimE, rimG, rimH, rimI, rimJ, rimK, rimL, rimM, rit, rlpA, rlpB, rluA, rluC, rluD, rmf, rna, rnb, rnc, rnd, rne, rnhA, rnhB, rnk, rnpA, rnpB, rnr, rnt, rob, rorB, rpe, rph, rpiA, rpiB, rpiR, rplA, rplB, rplC, rplD, rplE, rplF, rplI, rplJ, rplK, rplL, rplM, rplN, rplO, rplP, rplQ, rplR, rplS, rplT, rplU, rplV, rplW, rplX, rplY, rpmA, rpmB, rpmC, rpmD, rpmE, rpmF, rpmG, rpmH, rpmI, rpmJ, rpoA, rpoB, rpoC, rpoD, rpoE, rpoH, rpoN, rpoS, rpoZ, rpsA, rpsB, rpsC, rpsD, rpsE, rpsF, rpsG, rpsH, rpsI, rpsJ, rpsK, rpsL, rpsM, rpsN, rpsO, rpsP, rpsQ, rpsR, rpsS, rpsT, rpsU, rrfA, rrfB, rrfC, rrfD, rrfE, rrfF, rrfG, rrfH, rrlA, rrlB, rrlC, rrlD, rrlE, rrlG, rrlH, rrmA, rrsA, rrsB, rrsC, rrsD, rrsE, rrsG, rrsH, rsd, rseA, rseB, rseC, rspA, rspB, rssA, rssB, rsuA, rtcA, rtcB, rtcR, rtn, rus(qsr'), ruvA, ruvB, ruvC, sad, sanA, sapA, sapB, sapC, sapD, sapF, sbaA, sbcB, sbcC, sbcD, sbmA, sbmC (gyrI), sbp, sdaA, sdaB, sdaC, sdhA, sdhB, sdhC, sdhD, sdiA, sds, secA, secB, secD, secE, secF, secG, secY, selA, selB, selC, selD, semA, seqA, serA, serB, serC, serR, serS, serT, serU, serV, serW, serX, sfa, sfcA, sfiC, sfsA, sfsB, shiA, sipC, sipD, sir, sixA, sloB, slp, slr, slt, slyD, slyX, smp, smtA, sodA, sodB, sodC, sohA, sohB, solA, soxR, soxS, speA, speB, speC, speD, speE, speF, speG, spf, spoT, sppA, spr, srlA, srlB, srlD, srlE, srlR, srmB, srnA, ssaE, ssaG, ssaH, ssb, sseA, sseB, sspA, sspB, ssrA, ssrS, ssyA, ssyD, stfZ, stkA, stkB, stkC, stkD, stpA, strC, strM, stsA, sucA, sucB, sucC, sucD, sufI, sugE, suhA, suhB, sulA, supQ, surA, surE, syd, tabC, tag, talA, talB, tanA, tanB, tap, tar, tas, tauA, tauB, tauC, tauD, tbpA, tdcA, tdcB, tdcC, tdcD, tdcE, tdcF, tdcG, tdcR, tdh, tdi tdk, tehA, tehB, tesA, tesB, tgt, thdA, thdC, thdD, thiB?, thiC, thiD, thiE, thiF, thiG, thiH, thiI, thiJ, thiK, thiL, thiM, thrA, thrB, thrC, thrS, thrT, thrU, thrV, thrW, thyA, tig, tktA, tktB, tldD, tlnA, tmk, tnaA, tnaB, tnaC, tnm, tol-orfl, tol-orf2, tolA, tolB, tolC, tolD, tolE, tolI, tolJ, tolM, tolQ, tolR, tonB, topA, topB, torA, tor C, torD, tor R, tor S, torT, tpiA, tpr, tpx, treA, treB, treC, treF, treR, trg, trkA, trkD, trkG, trkH, trmA, trmB, trmC, trmD, trmE, trmF, trmH, trmU, trnA, trpA, trpB, trpC, trpD, trpE, trpR, trpS, trpT, truA, truB, trxA, trxB, trxC, tsaA, tsf, tsmA, tsr, tsx, ttdA, ttdB, ttk, tufA, tuffB, tus, tynA, tyrA, tyrB, tyrP, tyrR, tyrS, tyrT, tyrU, tyrV, ubiA, ubiB, ubiC, ubiD, ubiE, ubiF, ubiG, ubiH, ubiX, ucpA[ ], udk, udp, ugpA, ugpB, ugpC, ugpE, ugpQ, uhpA, uhpB, uhpC, uhpT, uidA, uidB, uidR, umuC, umuD, ung, upp, uppS, ups, uraA, usg-1, uspA, uup, uvh, uvrA, uvrB, uvrC, uvrD, uvs, uxaA, uxaB, uxaC, uxuA, uxuB, uxuR, valS, valT, valU, valV, valW, valX, valY, valZ, vsr, wrbA, xapA, xapB, xapR, xasA, xerC, xerD, xni, xseA, xseB, xthA, xylA, xylB, xylE, xylF, xylG, xylH, xylR, yccA, yhhP, yihG, yjaB, fl47, yjaD, yohF, yqiE, yrfE, zipA, zntA, znuA, znuB, znuC, zur, and zwf.

Non-limiting examples of mouse genes include: Ilr1, Ilr2, Gas10, Tnp1, Inhbb, Inha, Creb1, Mpmv34, Acrd, Acrg, Il110, Otf1, Rab11b-r, Abl1, ald, Amh-rs1, Bc12B, Cchlla3, Ccnb1-rs2, Gper16, Htr5b, Idd5, Igfbp2, Igfbp5, I18rb, Kras2-rs1, Mov7, Mpmv6, Mpmv16, Mpmv22, Mpmv25, Mpmv29, Mpmv42, Mtv7, Mtv27, Mtv39, Oprk1, Otf3-rs1, Otf8, Otf11-rs1, Ptgs2, Ren1, Ren2, Ril3, Sxv, Taz4-rs1, Tgfb2, Wnt6, Xmmv6, Xmmv9, Xmmv36, Xmmv61, Xmmv74, Xmv21, Xmv32, Xmv41, Il2ra, Abl, Mpmv3, Rap1a-ps2, anx, Mpmv43, Ryr3, Ras12-4, Adra2b, Avp, Glvr1, Il1a, Il1b, Mpmv28, Oxt, Pcsk2, a, Xmv10, Tcf4, Acra, Acra4, Ak1, Bdnf, bs, Cyct, Cyp24, Dbh, Fshb, Gcg, GdfS, Gnas, Gper8, Grin1, Hcs4, Hior2, Hsp84-2, Idd12, Ilrn, Jund2, Kras3, Mc3r, Mpmv14, Mtv40, Mxil-rsl, Otf3-rs2, Ptgs1, Ptpra, Rapsn, Src, Svp1, Svp3, Tcf3b, Wt1, Xmmv71, Xmv48, Ccna, Fgf2, Fth-rs1, Csfm, Mov10, Egf, Acrb2, Cap1, Crh, Fim3, Fps11, Glut2, Gper2, Gria2, Hsd3b-1, Hsd3b-2, Hsd3b-3, Hsd3b-4, Hsp86-ps2, Idd3, Il2, Il7, Mpvmv9, Mpmv20, Mtv4.8, Ngfb, Npra, Nras, Nras, Ntrk, Otf3-rs3, Otf3-rs4, Rapla, Tshb, Xmmv22, Xmmv65, Mos, Ras12-7, Lyr, Ifa, Ifb, Jun, azh, db, Ipp, Mp1, Do1, Ak2, Ccnb1-rs4, Cdc211, Cga, Fgr, Foc1, Fps12, Gabrr1, Gabrr2, Gdf6, Glut1, Gnb1, Gpcr14, Grb2-ps, Grik3, Grik5, Hsp86-1ps4, Htr1da, Htr1db, Idd9, Ifa1, Ifa2, Ifa3, Ifa4, IfaS, Ifa6, Ifa7, Ifa8, Ifa9, Ifa10, Lap18, Lmyc1, Mpmv19, Mpmv44, Mtv13, Mtv14, Mtv17, Nppb, Otf6, Otf7, Ri12, Ski, Tnfr2, Wnt4, Xmmv8, Xmmv23, Xmmv62, Xmv1, Xmv2, Xmv8, Xmv9, Xmv14, Xmv44, Xpa, Tec, Fgf5, Nos1, Tcf1, Epo, Gnb2, Flt1, Flt3, Ache, Adra2c, Adrbk2, Afp, Alb1, Ccnb1-rs1, Clock, Cyp3, Cyp3a11, Cyp3a13, Drd1b, Drd5, Fgfr3, Flk1, Gc, Gnrhr, Gper1, Hcs5, Hnf1, Htr5a, I15r, I16, Kit, Ltrm3, Mgsa, Mpmv7, Mpmv13, Mpmv23, Mtv32, Mtv41, Pdgfa, Pdgfra, Por, Txk, Xmmv3, Xmmv5, Xmmv52, Xmv17, Xmv28, Xmv34, Xmv38, Xmv45, Zp3, Trh, Raf1, Fth-rs2, Ntf3, Kras2, Pthlh, Mov1, Alox5, Braf2, Cftr, Egr4, Fps110, Fgf6, Gdf3, Ghrfr, Glut3, Grin2a, Hior3, Hoxa10, hop, Ica1, I15r, Int41, Itpr1, Krag, Mad, Met, Mi, Mtv8, Mtv23, Mtv29, Mtv33, Mtv34, Nkna, Npy, ob, Otf3-rs5, Tgfa, Tnfr1, Wnt2, Wnt5B, Wnt7A, Xmmv27, Xmv24, Xmv61, Fosb, Ryr1, Ngfa, Ufo, Xrcc1, Abpa, Abpga, Gabra4, Gas2, Acra7, Ccnb1-rs7, Egfbp3, Xmv30, Zp2, Fes, Pcsk3, Calc, Ccnb1-rs10, Pth, Ad, Bc13, Cea, Cea2, Cea3, Cea4, Cea5, Cea6, Cebp, Dm9, Dm15, Drd4, Egfbp1, Egfbp2, Ercc2, Fgf3, Fgfr2, Gabra5, Gabrb3, Gtx, Hcs1, Igf1r, Igf2, I14r, Ins2, Int40, Lhb, Mpmv1, Mtv1, Mtv35, Ngfg, Ntf5, Otf2, 2, Pkcc, Ras14, Rras, Ryr, Svp2, Tcf3g, Tgfb1, tub, Xmmv31, Xmmv35, Xmmv73, Xmv33, Xmv53, Taz83, Adrb3, Junb, Jund1, Me1, Gper19-rs2, Agt, Cadp, Ccnb1-rs9, E, Fgfr1, Gas6, Gnb-rs1, Hcs2, Insr, Maf, Mov34, Mpmv21, Mpmv41, Mtv21, Mtnr1a, Plat, Ras15-2, Ras16, Sntb2, Xmmv29, Xmv12, Xmv26, Xmv62, Epor, Gper13, Otf11, Pthr, Acra3, Acra5, Acrb4, Camk1, Cdc25Mm, Crbp, Crbp2, Csk, Cyp11a, Cyp19, Drd2, Etsl, Fli1, Gnai2, Gnat1, Gper6, Gria4, Hgf1, Hior1, Hpx, Hsp86-1ps3, Hst2, Idd2, I11bc, Lag-rs1, Lap18-rs1, M11, Mpmv27, Penk, Pgr, Ras12-2, Tp11, Trf, Xmmv2, Xmmv67, Xmv15, Xmv16, Xmv25, Xmv60, Mgf, Amh, Brat Cdc2a, Dmd1, Estr, Fps13, Fps14, Fps15, Gli, Gpcr17, Grik2, Ifgr, Igf1, Mpmv5, Mpmv12, Mpmv40, Myb, Oprm, Pg, Pmch, Ros1, Xmv31, Xmv51, Xmv54, Camk2b, Egfr, Int6, Lif, Mtv44, Ews, Csfgm, Flt4, I13, I14, I15, Irf1, Gria1, Giut4, Crhr, Csfg, Mov9, Xmv20, Acrb, Mpmv4, Mpmv15, Ngfr, Nos2, Rara, Taz4, Tcf2, Xmv42, Mtv3, Adra1, Crko, df, Erbb2, Gabra1, Gabra6, Gabrg2, Gh, Glra1, Grb2, Hnf1b, Hsp86-ps1, Idd4, Igfbp1, Igfbp3, I113, Int4, Mpmv2, Mpmv8, Mpmv18, Mtv45, nu, Pkca, Rabl, Rel, Shbg, Tcf7, Thra, Tnz1, Trp53, Wnt3, Wnt3A, Xmv4, Xmv5, Xmv47, Xmv49, Xmv63, Akt, Amh-rs4, Ccs1, Fps16, Fos, Gdf7, Hcs3, Hsp70-2, Hsp84-3, Hsp86-1, hyt, Ltrm1, Max, Mpmv11, Mpmv24, Mtv9, Mtv30, Pomc1, Tcf3a, Tda2, Tgfb3, Tpo, Tshr, Xmmv21, Xmmv25, Xmmv34, Xmmv50, Gli3, Xmv55, Ryr2, Inhba, Gas1, Pcsk1, Amh-rs2, Ccnbl-rs6, Ccnbl-rs13, Crhpb, Dat1, Drd1a, Fgfr4, Fps17, Fim1, Gper15, Gper18, Hbvi, Hilda, Htr1a,Idd11, I19, Ltrm4, Mak, mes, P11, P12, Pr1, Ra1, Rasa, Srd5a1, Tpbp, Xmv13, Xmv27, Rarb, Rbp3, Htr2, Rb1, Acra2, Camkg, Cch11a2, Ccnb1-rs5, Ccnb1-rs12, Gnrh, Mty11, Nras-ps, Otf3-rs6, Pfau, Ptprg, Trp53-ps, Wnt5A, Xmv19, Ghr, 117r, Lifr, M1vi2, Prlr, Myc, Ri11, cog, Amh-rs7, I12rb, Pdgfb, Acr, CP2, Rarg, Spl-1, Wnt1, Afr1, Atf4, Bzrp, Ccnb1-rs11, Cyp11b, I13rb1, I13rb2, Ins3, Itga, M1vi1, M1vi3, Mtv36, Pdgfec, Svp5, Tef, Trhr, Wnt7B, Xmmv55, Xmmv72, Xmv37, Tnp2, Ets2, Casr, Chuck-rs1, din, Drd3, Erg, G22pl, Gap43, Gas4, Grik1, Htrlf, Ifgt, 1 nt53, Ltrm2, Mpmv17, Mtv6, Mtvrl, Pit1, Xmv3, Xmv35, Xmv50, Igf2r, Mas, Tcd3, Glplr, Iddl, Tla, Aeg1, Ccnbl-rs3, Cdc2b, Csi, Cyp21, Cyp21-psl, Fps18, Gna-rs1, Gpcr19-rs1, Grr1, Grr2, Hom1, Hsc70t, Hsp70, Hsp70-1, Hsp84-1, Hst1, Hst4, Hst5, Hst6, Hye, Int3, Itpr3, Lap18-rs2, Otf3, Ptprs, Rab11b, Ras12-1, Ras12-3, Ras13, Rrs, Rxrb, Tas, Tcd1, Tcd2, Tera1, Tla-rs, Tnfa, Tnfb, Tpx1, Tpx2, Xmmv15, Xmv36, Xmv57, Csfmr, Pdgfrb, Adrb2, Apc, Camk2a, Camk4, Dcc, Fgf1, Gna1, Gper7, Gr11, Grp, Hsp74, Mcc, Mtv2, Mtv38, Ptpn2, Tp12, Xmv22, Xmv23, Xmv29, Fth, Csfgmra, Mxi1, Adra2a, Adrbl, Adrbkl, Chuck, Cyp17, Gna14, Gnb-psl, Hcs6, Htr7, Ide, Ins1, Lpc1, Pomc2, Seao, Tlx1, Xmmv42, Xmv18, Tcfe3, Araf, Avpr2, mdx, Ar, Zfx, Otf9, Ccg1, Ccnbl-rs8, Fps19, Gabra3, Glra2, Glra4, Gria3, Grpr, Hsp74-ps1, Hst3, Htr1c, I12rg, Mov14, Mov15, Mtv28, Otf3-rs8, Sts, Sxa, Sxr, Xta, Tdy, Hya, Zfy1, Zfy2, Mov15, Mov24, Mtv31, Mtv42, Sdma, Spy, Sts, Sxa, Sxr, XmmvY, Xmv7, Xmv11, and Xmv40.

Non-limiting examples of *Phaseolus vulgaris* genes include: Acc, ace, Adk, Am, Amv-1, Amv-2, Ane, aph, Arc, Are, arg, Arl (Arc), asp, B, be-u, bc-1.sup.1, bc-1.sup.2, bc-2.sup.1, bc-2.sup.2, be-3, Bcm, Beg, Bip, blu, Bpm, Bsm, By-1, By-2, C, C/c, c.sup.cr, C.sup.cir, C.sup.ma (M, R.sup.ma), C.sup.r, C.sup.res, C.sup.rho, C.sup.st, [C.sup.st R Acc] (Aeq), c.sup.0 (inh, i.sub.e), [c.sup.0 Prp.sup.i] (Prp, c.sup.ui, Nud), [c.sup.uprp.sup.st] (prp.sup.st), [C Prp] (Prp), c.sup.v, [C R] (R), [C r] (r), Ca, Cam, Cav, cc, ch1, c1, cm1, Co-1 (A), Co-2 (Are), Co-3 (Mexique 1), Co-3.sup.2, Co-4 (Mexique 2), Co-5 (Mexique 3), Co-6, Co-7, cr-1 cr-2, cry, cs, Ct, ctv-1 ctv-2, cyv (by-3), D (Can, Ins), Da, Db, def, dgs (gl, le), dia, Diap-1, Diap-2; diff, dis, D1-1D1-2 (DL-.sub.1 DL.sub.2), do, ds (te), dt-1.sup.a dt-2.sup.a, dt-1.sup.b dt-2.sup.b, dw-1 dw-2, Ea Eb, ers (restr), ers-2, Est-1, Est-2, exp, F, Fa, fast, Fb Fc, fa fb fc, Fcr, Fcr-2, fd, Fe-1 Fe-2, Fin (in), Fop-1, Fop-2, Fr, Fr-2, G (Flay, Ca, Och), Ga, gas, glb, Gpi-cl, Gr, Hbl (L.sub.HB-1), Hbnc (SC.sub.HB-1), Hbp (PD.sub.HB-1), hmb, Hss, Hsw, Ht-1 Ht-2 (L-1 L-2), I, Ia Ib, ian-1 ian-2 (ia), lbd, ico, Igr (Ih), ilo, ip, iter, iv, iw, J (Sh), Ke, L, la, Lan, Ld, Lds (Ds), Lec, Li (L), lo, Ir-11r-2, mar, Me, MeI (Me), MeI-2 (Me-2), mel-3 (me-3), Mf, mi, mia, Mic (Mip), miv, Mrf, Mrf.sup.2, mrf, ms-1, Mue, mu mutator, Nag, Nd-1 Nd-2 (D-1D-2), nie, and (sym-1), nnd-2, No, nts (nod), Nudus, ol, P, p.sup.gri (Gri, v.sup.Pal), pa, pc, pg (pa.sub.1), Pha, Pmv, ppd (neu), Pr, prc (pc), Prx, punc, ram, Rbcs (rbcS), rf-1, rf-2, rf-3, rfi (i), Rfs (m), Rk, rk, rk.sup.d (lin), rn-1 m-2 (r r), rnd, Ro, Sal, sb, sb.sup.ms, sb-2, sb-3, si1, Skdh, s1, Smv, St, Sur, sw-1 sw-2, T, t (z-1), Th-1 Th-2, Tm, To, Tor (T), Tr, tri, try, Ts, tw, uni, Uni-2, uni.sup.nde, uni.sup.nie, Ur-1, Ur-2, Ur-2.sup.2, Ur-3 (Ur-3, Ur-4), Ur-3.sup.2, Ur-4, (Up-2, Ur-C), Ur-5, (B-190), Ur-6 (Ur.sub.a, Ur-G), Ur-7 (R.sub.B11), Ur-8 (Up-1), Ur-9 (Ur.sub.p), us, V (B1), v.sup.lae (Cor), v, var, vi (vir.sub.f), wb, Wmv, X.sup.su, y. and Z.

Non-limiting examples of *Saccharomyces cerevisiae* genes include: PRE3, PUP1, PUP3, PRE2, PRE10, PRE1, PRE8, SCL1, PUP2, PRE5, PRE7, PRE4, RPT2, RPT3, RPN3, RPN11, RPN12, RPT6, RPN1, RPN2, RPT1, RPT5, RPT4, SKI6, RRP4, DIS3, TSC10, RAT1, GND1, EXO70, ERG10, ACC1, RPP0, ACT1, ARP100, ARP3, PAN1, ARP2, ARP4, ARP9, SPE2, CYR1, ALA1, TPS1, TUB1, ABF1, DED81, NIP1, YHC1, SNU71, ATM1, MAKS, ROK1, DED1, SPB4, AUR1, PSE1, ALG1, TUB2, BPL1, MSL5, ERG24, ERG26, ERG25, CMD1, HCA4, SHE9, SHE10, CAK1, PIS1, CHO1, CDS1, ESR1, NUD1, CDC47, CDC13, CDC37, CDC1, CDC4, CDC20, CDC6, CDC46, CDC3, KAR1, BBP1, HRP1, CCT2, CCT3, HSP10, SMC1, SMC2, CHC1, CFT2, CLPI, COP1, SEC26, SEC27, RET2, SEC21, COF1, CCT4, CCT1, CCT6, SEC24, SECT, PCF11, RNA15, RNA14, FIP1, YSH1, TFB4, TSM1, APC2, APC5, SEC31, TAF47, TAP42, MPP10, CDC53, CKS1, CDC28, KIN28, CNS1, ERG11, DBP10, DBP8, PRO3, DYS1, ALR1, TID3, DNA2, SSL2, RAD3, RFA3, RFA2, RFAI, RFC4, RFC5, RFC3, RFC2, RFC1, TOP2, RAP1, RPC25, PRI2, PRI1, POL1, POL12, HUS2, CDC2, POL2, DPB2, RPB10, RPA135, RPA190, RPA43, RPB8, RPO26, RPB5, RPC40, RPC19, SRB7, SRB4, RGR1, RPB11, SRB6, RPB2, RPB7, RPO21, RET1, RPO31, RPC31, RPC34, RPC53, RPC82, RPB12, RPB3, DPM1, DIP2, RNT1, CDC8, CDC14, DUT1, UBA2, UBA1, UBC9, CDC34, ENP1, ERD2, SSS1, SEC61, SEC63, SEC62, GNA1, GPI8, DAM1, DUO1, IRR1, PRP3, TIM9, HSH49, SUP35, EXM2, MEX67, ERG9, ERG20, FAS2, FAS1, NOP1, FAD1, AOS1, FBA1, NCB2, BRN1, TUB4, GDI1, GOG5, SRM1, CDC25, SPT16, YIF2, BET4, CDC43, MRS6, BET2, PRO1, GLN1, GLN4, GRS1, YIP1, FOL2, GPA1, CDC42, SAR1, YPT1, SEC4, GSP1, TEM1, RHO1, CDC24, RNA1, GUK1, VMA16, PMA1, HKR1, SIS1, MGE1, HSP60, HSF1, HAS1, MOT3, HTS1, ESA1, HSL7, HOM6, RIB7, SLY1, CSL4, PUR5, CSE1, IPP1, MDM1, USO1, SOF1, MAK11, LAS1, TEL2, DPB11, SGD1, FAL1, MTR3, MTR4, SPP2, SIK1, RRP7, POP4, RRP1, POP3, BFR2, CDC5, NRD1, MET30, MCM6, RRP46, SAS10, SCC2, ECO1, PRP43, BET3, BET5, STN1, NFS1, IDI1, SRP1, KAP95, CBF2, SKP1, CEP3, CTF13, ERG7, KRS1, PSA1, PMI40, ALG2, SSF1, MED7, RSC4, CDC54, MCM2, AFG2, ERG12, MVD1, CDC48, MHP1, ERV1, SSC1, TIM44, TIM17, TIM23, TOM22, TOM40, MAS1, MCD1, MMC1, STU1, JAC1, ABD1, CEG1, PAB1, MTR2, SEC16, ROT1, INO1, MLC1, MYO2, GPI2, SPT14, NAT2, NMT1, TRM1, NCP1, NBP1, ACF2, SPP41, NUT2, LCP5, PRP19, NMD3, RFT1, NNF1, NDC1, CRM1, KAR2, NIP29, NAB2, NIC96, NUP145, NUP49, NUP57, NUP159, NSP1, NUP82, CDC39, NPL4, POP7, NTF2, MAK16, NPL3, NOP2, NOP4, NHP2, NOPIO, GAR, NBP35, WBPI, STT3, SWP1, OST2, OST1, ORC1, ORC6, ORC5, ORC4, ORC3, RRR1, SAT2, PWP2, PEX3, TOR2, PIK1, SEC14, STT4, MSS4, PCM1, GPM1, SEC53, ERG8, YPD1, PAP1, NAB3, RRN7, SEN1, CFT1, PRP11, PRP21, PRP39, PRP24, PRP9, SLU7, PRP28, PRP31, IFH1, PTA1, SUB2, FMI1, MAS2, ESS1, PFY1, POL30, POP1, PDII, RAM2, CDC7, SMP3, CDC15, YTH1, QRI2, YAE1, SFI1, SEC1, BET1, SEC6, SEC13, SEC2, SEC8, CBF5, CDC19, YRB1, RHC18, DBF4, SDS22, MCM3, CEF1, ALG11, GAA1, MOB1, NIP7, TIP20, SEC5, SEC10, GPI10, RRP3, CDC45, DIB1, MIF2, HOP2, PBN1, NOP5, RPP1, POP5, POP5, POP6, ERO1, MPT1, DNA43, ESP1, SMC3, LST8, STS1, RPM2, RNR1, RNR2, RNR4, RPS20, RPL25, RPL3, RPL30, RPL32, RPL37A, RPL43A, RPL5, RPL10, RPS3, CET1, YRA1, SNM1, GLE1, DBP5, DRS1, DBP6, BRR2, RRN3, RRN6, RRN11, MED6, PRP16, RPR2, DIM1, RRP43, RRP42, RRP45, SEC20, BOS1, CDC12, GLC7, PKC1, IPL1, SGV1, NRK1, RAD53, LCB2, LCB1, MPS1, SES1, SPC3, SEC11, RIO1, ARP7, NEOI, YJU2, POB3, ARH1, IQG1, HRT1, HYMI, MAK21, FUN20, FUN9, NBN1, STB5, YIF1, SMX4, YKT6, SFTI, SMD1, PRP6, LSM2, NUF1, SPC97, SPC42, SPC98, CDC31, SPC19, SPC25, SPC34, SPC24, NUF2, PRP40, MCD4, ERG1, SMC4, CSE4, KRR1, SME1, TRA1, RLP7, SCH9, SMD3, SNP2, SSF2, SPC72, CDC27, CDC23, CDC16, APC1, APC11, APC4, ARC19, RPN6, RPN5, RSC6, RSC8, STH1, SFH1, TIM12, TIM22, TIM10, SQT1, SLS1, JSN1, STU2, SCD5, SSU72, ASM4, SED5, UFE1, SYF1, SYF2, CCT5, TBF1, TOA2, TOA1, SUA7, TAF90, TAF61, TAF25, TAF60, TAF17, TAF145, TAF19, TAF40, TAF67, TFA2, TFA1, FCP1, TFG1, TFG2, TFB1, CCL1, SSL1, TFB3, TFB2, PZF1, BRF1, TFC5, TFC4, TFC3, TFC7, TFC6, TFC1, SPT15, THI80, THS1, SPT6, SPT5, ROX3, REB1, MCM1, MED4, MOT1, MED8, EFB1, YEF3, SUI1, CDC95, TIF11, SUI3, GCD11, SUI2, GCD6, GCD7, GCD2, GCD1, RPG1, GCD10, PRT1, TIF34, CDC33, TIF5, SUP45, GCD14, TIM54, SEC17, TPT1, TRL1, CCA1, SEN54, SEN2, SEN15, SEN34, WRS1, SLN1, TYS1, SNU56, PRP42, CUS1, PRP4, PRP8, SNU114, USS1, UFD1, SMT3, RSP5, QR11, ALG7, UGP1, VTI1, VAS1, SEC18, CTR86, and ZPR1.

In particular, viruses provided herein can be modified to express an anti-tumor antibody, an anti-metastatic gene or metastasis suppressor genes; cell matrix degradative genes; hormones; growth factors; immune modulatory molecules, including a cytokine, such as interleukins or interferons, a chemokine, including CXC chemokines, costimulatory molecules; ribozymes; transporter protein; antibody or fragment thereof; antisense RNA; siRNA; microRNAs; protein ligands; a mitosis inhibitor protein; an antimiotic oligopeptide; an anti-cancer polypeptide; anti-cancer antibiotics; angiogenesis inhibitors; anti-angiogenic factors; tissue factors; a prodrug converting enzyme; genes for tissue regeneration and reprogramming human somatic cells to pluripotency; enzymes that modify a substrate to produce a detectable product or signal or are detectable by antibodies; a viral attenuation factors; a superantigen; proteins that can bind a contrasting agent, chromophore, or a compound of ligand that can be detected; tumor suppressors; cytotoxic protein; cytostatic protein; genes for optical imaging or detection including luciferase, a fluorescent protein such as a green fluorescent protein (GFP) or GFP-like protein, a red fluorescent protein (RFP), a far-red fluorescent protein, a near-infrared fluorescent protein, a yellow fluorescent protein (YFP), an orange fluorescent protein (OFP), a cerulean fluorescent proein (CFP), or a blue fluorescent protein (BFP), and phycobiliproteins from certain cyanobacteria and eukaryotic algae, including phycoerythrins (red) and the phycocyanins (blue); genes for PET imaging; genes for MRI imaging; or genes to alter attenuation of the viruses. For example, exemplary heterologous genes for modification (e.g. insertion) of the viruses herein are set forth in Table 5.

Exemplary heterologous genes for modification of viruses herein are known in the art (see e.g. U.S. Pub. Nos. US2003-0059400, US2003-0228261, US2009-0117034, US2009-0098529, US2009-0053244, US2009-0081639 and US2009-0136917; U.S. Pat. Nos. 7,588,767 and 7,763,420; and International Pub. No. WO 2009/139921). A non-limiting description of exemplary genes encoding heterologous proteins for modification of virus strains provided herein is set forth in Table 5 below. The sequence of the gene and encoded proteins are known to one of skill in the art from the literature. Hence, provided herein are virus strains, including any of the clonal viruses provided herein, that contain nucleotides encoding any of the heterologous proteins listed in Table 5.

TABLE 5

| Detectable gene products | SEQ ID NO |
|---|---|
| Optical Imaging | |
| Luciferase | |
| bacterial luciferase | |
| luciferase (from *Vibrio harveyi* or *Vibrio fischerii*) | |
| luxA | 27 |
| luxB | 28 |
| luxC | 29 |
| luxD | 30 |
| luxE | 31 |
| luxAB | 314 |
| luxCD | 317 |
| luxABCDE | 323 |
| firefly luciferase | |
| *Renilla* luciferase from *Renilla renformis* | |
| *Gaussia* luciferase | |
| luciferases found among marine arthropods | |
| luciferases that catalyze the oxidation of *Cypridina* (*Vargula*) luciferin | |
| luciferases that catalyze the oxidation of Coleoptera luciferin | |
| luciferase photoproteins | |
| aequorin photoprotein to which luciferin is non-covalently bound | |
| click beetle luciferase | |
| CBG99 | |
| CBG99-mRFP1 | 25 |
| Fusion Proteins | |
| Ruc-GFP | 24 |
| Fluorescent Proteins | |
| GFP | |
| aequorin from *Aequorea victoria* | |
| GFP from *Aequorea victoria* | |
| GFP from *Aequorea coerulescens* | |
| GFP from the anthozoan coelenterates *Renilla reniformis* and *Renilla kollikeri* (sea pansies) | |
| Emerald (Invitrogen™, Carlsbad, CA) | |
| EGFP (Clontech, Palo Alto, CA) | |
| CoralHue® Azami-Green (MBL International, Woburn, MA) | |
| CoralHue® Kaede (MBL International, Woburn, MA) | |
| BD Living Colors™ ZsGreen1 (Clontech, Palo Alto, CA) | |
| CopGFP (Evrogen/Axxora, LLC, San Diego, CA) | |
| Anthozoa reef coral | |
| *Anemonia* sea anemone | |
| *Renilla* sea pansy | |
| *Galaxea* coral | |
| *Acropora* brown coral | |
| *Trachyphyllia* stony coral | |
| Pectiniidae stony coral | |
| GFP-like proteins | |
| RFP | |
| RFP from the corallimorph *Discosoma* (DsRed) (Matz et al. (1999) Nature Biotechnology 17: 969-973) | |
| *Heteractis* reef coral, *Actinia* or *Entacmaea* sea anemone | |
| RFPs from *Discosoma* variants | |
| mRFP1 (Wang et al. (2004) PNAS USA.101(48): 16745-9) | |
| mCherry (Wang et al. (2004) PNAS USA.101(48): 16745-9) | |
| tdTomato (Wang et al. (2004) PNAS USA.101(48): 16745-9) | |
| mStrawberry (Wang et al. (2004) PNAS USA.101(48): 16745-9) | |
| mTangerine (Wang et al. (2004) PNAS USA.101(48): 16745-9) | |
| BD Living Colors™ DsRed2 (Clontech, Palo Alto, CA) | |
| DsRed-T1 (Bevis and Glick (2002) Nat. Biotechnol. 20: 83-87) | |
| Anthomedusa J-Red (Evrogen) | |
| BD Living Colors™ *Anemonia* AsRed2 (Clontech, Palo Alto, CA) | |
| far-red fluorescent protein | |
| TurboFP635 | 283 |
| mNeptune monomeric far-red fluorescent protein | 85 |
| *Actinia* AQ143 (Shkrob et al. (2005) *Biochem J.* 392(Pt 3): 649-54) | |
| *Entacmaea* eqFP611 (Wiedenmann et al. (2002) PNAS USA. 99(18): 11646-51) | |
| *Discosoma* variants | |
| mPlum (Wang et al.. (2004) PNAS USA.101(48): 16745-9) | |
| mRasberry (Wang et al. (2004) PNAS USA.101(48): 16745-9) | |
| BD Living Colors™ *Heteractis* HcRed1 and t-HcRed (Clontech, Palo Alto, CA) | |

TABLE 5-continued

| Detectable gene products | SEQ ID NO |
|---|---|
| IFP (infrared fluorescent protein) | 284 |
| near-infrared fluorescent protein | |
| YFP | |

EYFP (Clontech, Palo Alto, CA)
YPet (Nguyen and Daugherty (2005) *Nat Biotechnol.* 23(3): 355-60)
*Venus* (Nagai et al. (2002) *Nat. Biotechnol.* 20(1): 87-90)
BD Living Colors™ ZsYellow (Clontech, Palo Alto, CA)
mCitrine (Wang et al. (2004) PNAS USA.101(48): 16745-9)
OFP cOFP (Stratagene, La Jolla, CA)
CoralHue® mKO (MBL International, Woburn, MA)
mOrange (Wang et al.. (2004) PNAS USA.101(48): 16745-9)
CFP Cerulean (Rizzo (2004) *Nat Biotechnol.* 22(4): 445-9)
mCFP (Wang et al. (2004) PNAS USA.101(48): 16745-9)
BD Living Colors™ AmCyan1 (Clontech, Palo Alto, CA)
CoralHue® MiCy (MBL International, Woburn, MA)
CyPet (Nguyen and Daugherty (2005) *Nat Biotechnol.* 23(3): 355-60)
BFP EBFP (Clontech, Palo Alto, CA);
phycobiliproteins from certain cyanobacteria and eukaryotic algae, phycoerythrins
(red) and the phycocyanins (blue)
R-Phycoerythrin (R-PE)
B-Phycoerythrin (B-PE)
Y-Phycoerythrin (Y-PE
C-Phycocyanin (P-PC)
R-Phycocyanin (R-PC)
Phycoerythrin 566 (PE 566)
Phycoerythrocyanin (PEC)
Allophycocyanin (APC)

| | |
|---|---|
| frp Flavin Reductase | 84 |
| CBP Coelenterazine-binding protein 1 | 86 |
| PET imaging | |
| Cyp11B1 transcript variant 1 | 40 |
| Cyp11B1 transcript variant 2 | 39 |
| Cyp11B2 | 41 |
| AlstR | 87 |
| PEPR-1 | 194 |
| LAT-4 (SLC43A2) | 88 |
| Cyp51 transcript variant 1 | 42 |
| Cyp51 transcript variant 2 | 43 |
| Transporter proteins | |
| Solute carrier transporter protein families (SLC) | |

SLC1 solute carrier 1 transporter protein family
SLC1A1, SLC1A2, SLC1A3, SLC1A4, SLC1A5, SLC1A6, SLC1A7
SLC2 solute carrier 2 transporter protein family
SLC2A1, SLC2A2, SLC2A3, SLC2A4, SLC2A5, SLC2A6, SLC2A7, SLC2A8,
SLC2A9, SLC2A10, SLC2A11, SLC2A12, SLC2A13, SLC2A14)
SLC3 solute carrier 3 transporter protein family
SLC3A1, SLC3A2
SLC 4 solute carrier 4 transporter protein family
SLC4A1, SLC4A2, SLC4A3, SLC4A4, SLC4A5, SLC4A6, SLC4A7, SLC4A8,
SLC4A9, SLC4A10, SLC4A11
SLC5 solute carrier 5 transporter protein family

| | |
|---|---|
| SLC5A1 sodium/glucose cotransporter 1 | 109 |
| SLC5A2 sodium/glucose cotransporter 2 | 110 |
| SLC5A3 sodium/myo-inositol cotransporter | 111 |
| SLC5A4 low affinity sodium-glucose cotransporter | 112 |
| SLC5A5 sodium/iodide cotransporter | 108 |
| SLC5A6 sodium-dependent multivitamin transporter | 113 |
| SLC5A7 high affinity choline transporter 1 | 114 |
| SLC5A8 sodium-coupled monocarboxylate transporter 1 | 115 |
| SLC5A9 sodium/glucose cotransporter 4 | 116 |
| SLC5A10 sodium/glucose cotransporter 5, isoform 1 | 117 |
| sodium/glucose cotransporter 5, isoform 2 | 118 |
| sodium/glucose cotransporter 5, isoform 3 | 119 |
| sodium/glucose cotransporter 5, isoform 4 | 120 |
| SLC5A11 sodium/myo-inositol cotransporter 2, isoform 1 | 121 |
| sodium/myo-inositol cotransporter 2, isoform 2 | 122 |
| sodium/myo-inositol cotransporter 2, isoform 3 | 123 |
| sodium/myo-inositol cotransporter 2, isoform 4 | 124 |

TABLE 5-continued

| Detectable gene products | SEQ ID NO |
|---|---|
| SLC5A12 sodium-coupled monocarboxylate transporter 2, isoform 1 | 125 |
| sodium-coupled monocarboxylate transporter 2, isoform 2 | 126 |
| Sodium Iodide Symporter (NIS) | |
| hNIS (NM_000453) | 36 |
| hNIS (BC105049) | 37 |
| hNIS (BC105047) | 38 |
| hNIS (non-functional hNIS variant containing an additional 11 aa) | |
| SLC6 solute carrier 6 transporter protein family | |
| SLC6A1 sodium- and chloride-dependent GABA transporter 1 | 130 |
| SLC6A2 norepinephrine transporter (sodium-dependent noradrenaline transporter) | 127 |
| SLC6A3 sodium-dependent dopamine transporter | 129 |
| SLC6A4 sodium-dependent serotonin transporter | 128 |
| SLC6A5 sodium- and chloride-dependent glycine transporter 1 | 133 |
| SLC6A6 sodium-and chloride-dependent taurine transporter | 136 |
| SLC6A7 sodium-dependent proline transporter | 135 |
| SLC6A8 sodium- and chloride-dependent creatine transporter | 138 |
| SLC6A9 sodium- and chloride-dependent glycine transporter 1, isoform 1 | 134 |
| sodium- and chloride-dependent glycine transporter 1, isoform 2 | 139 |
| sodium- and chloride-dependent glycine transporter 1, isoform 3 | 140 |
| SLC6A10 sodium- and chloride-dependent creatine transporter 2 | 141 |
| SLC6A11 sodium- and chloride-dependent GABA transporter 3 | 132 |
| SLC6A12 sodium- and chloride-dependent betaine transporter | 137 |
| SLC6A13 sodium- and chloride-dependent GABA transporter 2 | 131 |
| SLC6A14 Sodium- and chloride-dependent neutral and basic amino acid transporter B(0+) | 142 |
| SLC6A15 Orphan sodium- and chloride-dependent neurotransmitter transporter NTT73 | 143 |
| SLC6A16 Orphan sodium- and chloride-dependent neurotransmitter transporter NTT5 | 144 |
| SLC6A17 Orphan sodium- and chloride-dependent neurotransmitter transporter NTT4 | 145 |
| Sodium SLC6A18 Sodium- and chloride-dependent transporter XTRP2 | 146 |
| SLC6A19 Sodium-dependent neutral amino acid transporter B(0) | 147 |
| SLC6A20 Sodium- and chloride-dependent transporter XTRP3 | 148 |
| Norepinephrine Transporter (NET) | |
| Human Net (hNET) transcript variant 1 (NM_001172504) | 32 |
| Human Net (hNET) transcript variant 2 (NM_001172501) | 33 |
| Human Net (hNET) transcript variant 3 (NM_001043) | 34 |
| Human Net (hNET) transcript variant 4 (NM_001172502) | 35 |
| Non-Human Net | |
| SLC7 solute carrier 7 transporter protein family | |
| SLC7A1, SLC7A2, SLC7A3, SLC7A4, SLC7A5, SLC7A6, SLC7A7, SLC7A8, SLC7A9, SLC7A10, SLC7A11, SLC7A13, SLC7A14 | |
| SLC8 solute carrier 8 transporter protein family | |
| SLC8A1, SLC8A2, SLC8A3 | |
| SLC9 solute carrier 9 transporter protein family | |
| SLC9A1, SLC9A2, SLC9A3, SLC9A4, SLC9A5, SLC9A6, SLC9A7, SLC9A8, SLC9A9, SLC9A10, SLC9A11 | |
| SLC10 solute carrier 10 transporter protein family | |
| SLC10A1, SLC10A2, SLC10A3, SLC10A4, SLC10A5, SLC10A6, SLC10A7 | |
| SLC11 solute carrier 11 transporter protein family | |
| SLC11A1 | |
| SCL11A2 or hDMT | |
| SLC11A2 transcript variant 4 | 54 |
| SLC11A2 transcript variant 1 | 55 |
| SLC11A2 transcript variant 2 | 56 |
| SLC11A2 transcript variant 3 | 57 |
| SLC11A2 transcript variant 5 | 58 |
| SLC11A2 transcript variant 6 | 59 |
| SLC11A2 transcript variant 7 | 60 |
| SLC12 solute carrier 12 transporter protein family | |
| SLC12A1, SLC12A1, SLC12A2, SLC12A3, SLC12A4, SLC12A5, SLC12A6, SLC12A7, SLC12A8, SLC12A9 | |
| SLC13 solute carrier 13 transporter protein family | |
| SLC13A1, SLC13A2, SLC13A3, SLC13A4, SLC13A5 | |
| SLC14 solute carrier 14 transporter protein family | |
| SLC14A1, SLC14A2 | |
| SLC15 solute carrier 15 transporter protein family | |
| SLC15A1, SLC15A2, SLC15A3, SLC15A4 | |
| SLC16 solute carrier 16 transporter protein family | |
| SLC16A1, SLC16A2, SLC16A3, SLC16A4, SLC16A5, SLC16A6, SLC16A7, SLC16A8, SLC16A9, SLC16A10, SLC16A11, SLC16A12, SLC16A13, SLC16A14 | |
| SLC17 solute carrier 17 transporter protein family | |
| SLC17A1, SLC17A2, SLC17A3, SLC17A4, SLC17A5, SLC17A6, SLC17A7, SLC17A8 | |

TABLE 5-continued

| Detectable gene products | SEQ ID NO |
|---|---|
| SLC18 solute carrier 18 transporter protein family | |
| SLC18A1, SLC18A2, SLC18A3 | |
| SLC19 solute carrier 19 transporter protein family | |
| SLC19A1, SLC19A2, SLC19A3 | |
| SLC20 solute carrier 20 transporter protein family | |
| SLC20A1, SLC20A2 | |
| SLC21 solute carrier 21 transporter protein family | |
| subfamily 1; SLCO1A2, SLCO1B1, SLCO1B3, SLCO1B4, SLCO1C1 | |
| subfamily 2; SLCO2A1, SLCO2B1 | |
| subfamily 3; SLCO3A1 | |
| subfamily 4; SLCO4A1, SLCO4C1 | |
| subfamily 5; SLCO5A1 | |
| SLC22 solute carrier 22 transporter protein family | |
| SLC22A1, SLC22A2, SLC22A3, SLC22A4, SLC22A5, SLC22A6, SLC22A7, SLC22A8, SLC22A9, SLC22A10, SLC22A11, SLC22A12, SLC22A13, SLC22A14, SLC22A15, SLC22A16, SLC22A17, SLC22A18, SLC22A19, SLC22A20 | |
| SLC23 solute carrier 23 transporter protein family | |
| SLC23A1, SLC23A2, SLC23A3, SLC23A4 | |
| SLC24 solute carrier 24 transporter protein family | |
| SLC24A1, SLC24A2, SLC24A3, SLC24A4, SLC24A5, SLC24A6 | |
| SLC25 solute carrier 25 transporter protein family | |
| SLC25A1, SLC25A2, SLC25A3, SLC25A4, SLC25A5, SLC25A6, SLC25A7, SLC25A8, SLC25A9, SLC25A10, SLC25A11, SLC25A12, SLC25A13, SLC25A14, SLC25A15, SLC25A16, SLC25A17, SLC25A18, SLC25A19, SLC25A20, SLC25A21, SLC25A22, SLC25A23, SLC25A24, SLC25A25, SLC25A26, SLC25A27, SLC25A28, SLC25A29, SLC25A30, SLC25A31, SLC25A32, SLC25A33, SLC25A34, SLC25A35, SLC25A36, SLC25A37, SLC25A38, SLC25A39, SLC25A40, SLC25A41, SLC25A42, SLC25A43, SLC25A44, SLC25A45, SLC25A46 | |
| SLC26 solute carrier 26 transporter protein family | |
| SLC26A1, SLC26A2, SLC26A3, SLC26A4, SLC26A5, SLC26A6, SLC26A7, SLC26A8, SLC26A9, SLC26A10, SLC26A11 | |
| SLC27 soluote carrier 27 transporter protein family | |
| SLC27A1, SLC27A2, SLC27A3, SLC27A4, SLC27A5, SLC27A6 | |
| SLC28 solute carrier 28 transporter protein family | |
| SLC28A1, SLC28A2, SLC28A3 | |
| SLC29 solute carrier 29 transporter protein family | |
| SLC29A1, SLC29A2, SLC29A3, SLC29A4 | |
| SLC30 solute carrier 30 transporter protein family | |
| SLC30A1, SLC30A2, SLC30A3, SLC30A4, SLC30A5, SLC30A6, SLC30A7, SLC30A8, SLC30A9, SLC30A10 | |
| SLC31 solute carrier 31 transporter protein family | |
| SLC31A1 | |
| SLC32 solute carrier 32 transporter protein family | |
| SLC32A1 | |
| SLC33 solute carrier 33 transporter protein family | |
| SLC33A1 | |
| SLC34 solute carrier 34 transporter protein family | |
| SLC34A1, SLC34A2, SLC34A3 | |
| SLC35 solute carrier 35 transporter protein family | |
| subfamily A; SLC35A1, SLC35A2, SLC35A3, SLC35A4, SLC35A5 | |
| subfamily B; SLC35B1, SLC35B2, SLC35B3, SLC35B4 | |
| subfamily C; SLC35C1, SLC35C2 | |
| subfamily D; SLC35D1, SLC35D2, SLC35D3 | |
| subfamily E; SLC35E1, SLC35E2, SLC35E3, SLC35E4 | |
| SLC36 solute carrier 36 transporter protein family | |
| SLC36A1, SLC36A2, SLC36A3, SLC36A4 | |
| SLC37 solute carrier 37 transporter protein family | |
| SLC37A1, SLC37A2, SLC37A3, SLC37A4 | |
| SLC38 solute carrier 38 transporter protein family | |
| SLC38A1, SLC38A2, SLC38A3, SLC38A4, SLC38A5, SLC38A6 | |
| SLC39 solute carrier 39 transporter protein family | |
| SLC39A1, SLC39A2, SLC39A3, SLC39A4, SLC39A5, SLC39A6, SLC39A7, SLC39A8, SLC39A9, SLC39A10, SLC39A11, SLC39A12, SLC39A13, SLC39A14 | |
| SLC40 solute carrier 40 transporter protein family | |
| SLC40A1 | |
| SLC41 solute carrier 41 transporter protein family | |
| SLC41A1, SLC41A2, SLC41A3 | |
| SLC42 solute carrier 42 transporter protein family | |
| RHAG, RhBG, RhCG | |
| SLC43 solute carrier 43 transporter protein family | |
| SLC43A1 | |
| SLC43A2 | 88 |
| SLC43A3 | |

TABLE 5-continued

| Detectable gene products | SEQ ID NO |
|---|---|
| SLC44 solute carrier 44 transporter protein family | |
| SLC44A1, SLC44A2, SLC44A3, SLC44A4, SLC44A5 | |
| SLC45 solute carrier 45 transporter protein family | |
| SLC45A1, SLC45A2, SLC54A3, SLC45A4 | |
| SLC46 solute carrier 46 transporter protein family | |
| SLC46A1, SLC46A2 | |
| SLC47 solute carrier 47 transporter protein family | |
| SLC47A1, SLC47A2 | |
| MRI Imaging | |
| Human transferrin receptor | 44 |
| Human transferrin receptor | 45 |
| Mouse transferrin receptor | 46 |
| Human ferritin light chain (FTL) | 47 |
| Human ferritin heavy chain | 48 |
| FTL 498-199InsTC, a mutated form of the ferritin light chain | 285 |
| Bacterial ferritin | |
| E. coli | 49 |
| E. coli strain K12 | 50 |
| S. aureus strain MRSA252 | 51 |
| S. aureus strain NCTC 8325 | 52 |
| H. pylori B8 | 53 |
| bacterioferritin | 90 |
| codon optimized bacterioferritin | 290 |
| MagA | 280 |
| Enzymes that modify a substrate to produce a detectable product or signal, or are detectable by antibodies | |
| alpha-amylase | 195 |
| alkaline phosphatase | 196 |
| secreted alkaline phosphatase | |
| peroxidase | 198 |
| T4 lysozyme | |
| oxidoreductase | 199 |
| pyrophosphatase | 200 |
| Therapeutic genes | |
| therapeutic gene product | |
| antigens | |
| tumor specific antigens | |
| tumor-associated antigens | |
| tissue-specific antigens | |
| bacterial antigens | |
| viral antigens | |
| yeast antigens | |
| fungal antigens | |
| protozoan antigens | |
| parasite antigens | |
| mitogens | |
| an antibody or fragment thereof | |
| virus-specific antibodies | |
| antisense RNA | |
| siRNA | |
| siRNA directed against expression of a tumor-promoting gene | |
| an oncogene | |
| growth factor | |
| angiogenesis promoting gene | |
| a receptor | |
| siRNA molecule directed against expression of any gene essential for cell growth, cell replication or cell survival. | |
| siRNA molecule directed against expression of any gene that stabilizes the cell membrane or otherwise limits the number of tumor cell antigens released from the tumor cell. | |
| protein ligands | |
| an antitumor oligopeptide | |
| an antimitotic peptide | |
| tubulysin, | |
| phomopsin | |
| hemiasterlin | |
| taltobulin (HTI-286, 3) | |
| cryptophycin | |
| a mitosis inhibitor protein | |

TABLE 5-continued

| Detectable gene products | SEQ ID NO |
|---|---|
| an antimitotic oligopeptide | |
| an anti-cancer polypeptide antibiotic | |
| anti-cancer antibiotics | |
| tissue factors | |
| Tissue Factor (TF) | |
| αvβ3-integrin RGD fusion protein | |
| Immune modulatory molecules | |
| GM-CSF | 61 |
| MCP-1 or CCL2 (Monocyte Chemoattractant Protein-1) Human | 62 |
| MCP-1 murine | 201 |
| IP-I0 or Chemokine ligand 10 (CXCL10) | 66 |
| LIGHT | 281 |
| P60 or SEQSTM1 (Sequestosome 1 transcript variant 1) | 67 |
| P60 or SEQSTM1 (Sequestosome 1 transcript variant 3) | 68 |
| P60 or SEQSTM1 (Sequestosome 1 transcript variant 2) | 69 |
| OspF | 202 |
| OspG | 203 |
| STAT1alpha | 70 |
| STAT1beta | 71 |
| Interleukins | |
| IL-18 (Interleukin-18) | 204 |
| IL-11 (Interleukin-11) | 205 |
| IL-6 (Interleukin-6) | 206 |
| sIL-6R-IL-6 | 16 |
| interleukin-12 | 207 |
| interleukin-1 | 208 |
| interleukin-2 | 209 |
| IL-24 (Interleukin-24) | 15 |
| IL-24 transcript variant 1 | 63 |
| IL-24 transcript variant 4 | 64 |
| IL-24 transcript variant 5 | 65 |
| IL-4 | 210 |
| IL-8 | 211 |
| IL-10 | 212 |
| chemokines | |
| IP-10 (CXCL) | 66 |
| Thrombopoetin | 214 |
| members of the C—X—C and C-C chemokine families | |
| RANTES | 215 |
| MIP1-alpha | 216 |
| MIP1-beta | 217 |
| MIP-2 | 213 |
| CXC chemokines | |
| GROα | 218 |
| GROβ (MIP-2) | 213 |
| GROγ | 219 |
| ENA-78 | 220 |
| LDGF-PPBP | 221 |
| GCP-2 | 222 |
| PF4 | 223 |
| Mig | 224 |
| IP-10 | 66 |
| SDF-1α/β | 225 |
| BUNZO/STRC33 | |
| 1-TAC | |
| BLC/BCA-1 | |
| MDC | |
| TECK | |
| TARC | |
| HCC-1 | |
| HCC-4 | |
| DC-CK1 | |
| MIP-3α | |
| MIP-3β | |
| MCP-2 | |
| MCP-3 (Monocyte Chemoattractant Protein-3, CCL7) | |
| MCP-4 | |
| MCP-5 (Monocyte Chemoattractant Protein-5; CCL12) | |
| Eotaxin (CCL11) | |
| Eotaxin-2/MPIF-2 | |
| I-309 | |
| MIP-5/HCC-2 | |

TABLE 5-continued

| Detectable gene products | SEQ ID NO |
|---|---|
| MPIF-1 | |
| 6Ckine | |
| CTACK | |
| MEC | |
| lymphotactin | |
| fractalkine | |
| Immunoglobulin superfamily of cytokines | |
| | |
| B7.1 | |
| B7.2. | |
| Anti-angiogenic genes/angiogenesis inhibitors | |
| | |
| Human plasminogen k5 domain (hK5) | 13 |
| PEDF (SERPINF1) (Human) | 72 |
| PEDF (mouse) | 282 |
| anti-VEGF single chain antibody (G6) | 73 |
| anti-DLL4 s.c. antibody GLAF-3 | 302 |
| tTF-RGD (truncated human tissue factor protein fused to an RGD peptide) | 14 |
| viral attenuation factors | |
| | |
| Interferons | |
| IFN-γ | |
| IFN-α | |
| IFN-β | |
| Antibody or scFv | |
| | |
| Therapeutic antibodies (i.e. anticancer antibodies) | |
| Rituximab (RITUXAN®) | |
| ADEPT | |
| Trastuzumab (Herceptin®) | |
| Tositumomab (Bexxar®) | |
| Cetuximab (Erbitux®) | |
| Ibritumomab (90Y-Ibritumomab tiuexetan; Zevalin®) | |
| Alemtuzumab (Campath®-1H) | |
| Epratuzumab (LymphoCide®) | |
| Gemtuzumab ozogamicin (Mylotarg®) | |
| Bevacimab (Avastin®) and Edrecolomab (Panorex®) | |
| Infliximab (REMICADE®) | |
| Metastasis suppressor genes | |
| | |
| NM23 or NME1 Isoform a | 74 |
| NM23 or NME1 Isoform b | 75 |
| Anti-metastatic genes | |
| | |
| E-Cad | 76 |
| Gelsolin | 226 |
| LKB1 (STK11) | 227 |
| RASSF1 | 228 |
| RASSF2 | 229 |
| RASSF3 | 230 |
| RASSF4 | 231 |
| RASSF5 | 232 |
| RASSF6 | 233 |
| RASSF7 | 234 |
| RASSF8 | 235 |
| Syk | 236 |
| TIMP-1 (Tissue Inhibitor of Metalloproteinase Type-1) | 237 |
| TIMP-2 (Tissue Inhibitor of Metalloproteinase Type-2) | 238 |
| TIMP-3 (Tissue Inhibitor of Metalloproteinase Type-3) | 239 |
| TIMP-4 (Tissue Inhibitor of Metalloproteinase Type-4) | 240 |
| BRMS-1 | 241 |
| CRMP-1 | 242 |
| CRSP3 | 243 |
| CTGF | 244 |
| DRG1 | 245 |
| KAI1 | 246 |
| KiSS1 (kisspeptin) | 247 |
| kisspeptin fragments | |
| kisspeptin-10 | |
| kisspeptin-13 | |
| kisspeptin-14 | |
| kisspeptin-54 | |
| Mkk4 | 248 |
| Mkk6 | 249 |
| Mkk7 | 250 |
| RKIP | |
| RHOGDI2 | |

TABLE 5-continued

| Detectable gene products | SEQ ID NO |
|---|---|
| SSECKS | |
| TXNIP/VDUP1 | |
| Cell matrix-degradative genes | |
| Relaxin 1 | 77 |
| hMMP9 | 78 |
| Hormones | |
| Human Erythropoietin (EPO) | 11 |
| MicroRNAs | |
| pre-miRNA 181a (sequence inserted into viral genome) | 291 |
| miRNA 181a | 292 |
| mmu-miR-181a MIMAT0000210 mature miRNA 181a | 293 |
| pre-miRNA 126 (sequence inserted into the vial genome) | 294 |
| miRNA 126 | 295 |
| hsa-miR-126 MI000471 | 296 |
| hsa-miR-126 MIMAT0000445 | 297 |
| pre-miRNA 335 (sequence inserted into the viral genome) | 298 |
| miRNA 335 | 299 |
| hsa-miR-335 MI0000816 | 300 |
| hsa-miR-335 MIMAT0000765 | 301 |
| Genes for tissue regeneration and reprogramming Human somatic cells to pluripotency | |
| nAG | 255 |
| Oct4 | 256 |
| NANOG | 257 |
| Ngn (Neogenin 1) transcript variant 1 | 79 |
| Ngn (Neogenin 1) transcript variant 2 | 80 |
| Ngn (Neogenin 1) transcript variant 3 | 81 |
| Ngn3 | 258 |
| Pdx1 | 82 |
| Mafa | 83 |
| Additional Genes | |
| Myc-CTR1 | 259 |
| FCU1 | 260 |
| mMnSOD | 287 |
| HACE1 | 261 |
| nppa1 | 262 |
| GCP-2 (Granulocyte Chemotactic Protein-2, CXCL6) | 222 |
| hADH | 288 |
| Wildtype CDC6 | 264 |
| Mut CDC6 | 328 |
| GLAF-3 anti-DLL4 scFv | 302 |
| GLAF-4 anti-FAP (Fibroblast Activation Protein) scFv (Brocks et al., (2001) *Mol. Medicine* 7(7): 461-469) | 306 |
| GLAF-5 anti-FAP scFv | 310 |
| BMP4 | 265 |
| wildtype F14.5L | 266 |
| Other Proteins | |
| WT1 | 267 |
| p53 | 268 |
| *Pseudomonas* exotoxin | |
| diphtheria toxin | |
| Arf or p16 | 269 |
| Bax | 270 |
| Herpes simplex virus thymidine kinase | |
| *E. coli* purine nucleoside phosphorylase | |
| angiostatin | |
| endostatin | |
| Rb | |
| BRCA1 | 271 |
| cystic fibrosis transmembrane regulator (CFTR) | 272 |
| Factor VIII | 273 |
| low density lipoprotein receptor | 274 |
| alpha-galactosidase | 275 |
| beta-glucocerebrosidase | 276 |
| insulin | 277 |
| parathyroid hormone | 278 |
| alpha-1-antitrypsin | 279 |
| rsCD40L | |
| Fas-ligand | |
| TRAIL | |
| TNF | |
| microcin E492 | |

TABLE 5-continued

| Detectable gene products | SEQ ID NO |
|---|---|
| xanthineguanine phosphoribosyltransferase (XGPRT) | |
| *E. coli* guanine phosphoribosyltransferase (gpt) | |
| hyperforin | |
| endothelin-1 (ET-1) | |
| connective tissue growth factor (CTGF) | |
| vascular endothelial growth factor (VEGF) | |
| cyclooxygenase | |
| COX-2 | |
| cyclooxygenase-2 inhibitor | |
| MPO (Myeloperoxidase) | |
| Apo A1 (Apolipoprotein A1) | |
| CRP (C Reactive Protein) | |
| Fibrinogen | |
| SAP (Serum Amyloid P) | |
| FGF-basic (Fibroblast Growth Factor-basic) | |
| PPAR-agonist | |
| PE37/TGF-alpha fusion protein | |
| Replacement of the A34R gene with another A34R gene from a different strain in order to increase the EEV form of the virus | |
| A34R from VACV 1HD-J | 286 |
| A34R with a mutation at codon 151 (Lys 151 to Asp) | |
| A34R with a mutation at codon 151 (Lys 151 to Glu) | |
| Non-coding Sequence | |
| Non-proteins | |
| Non-coding nucleic acid | |
| Ribozymes | |
| Group I introns | |
| Group II introns | |
| RNaseP | |
| hairpin ribozymes | |
| hammerhead ribozymes | |
| Prodrug converting enzymes | |
| varicella zoster thymidine kinase | |
| cytosine deaminase | |
| purine nucleoside phosphorylase (e.g., from *E. coli*) | |
| beta lactamase | |
| carboxypeptidase G2 | |
| carboxypeptidase A | |
| cytochrome P450 | |
| cytochrome P450-2B1 | |
| cytochrome P450-4B1 | |
| horseradish peroxidase | |
| nitroreductase | |
| rabbit carboxylesterase | |
| mushroom tyrosinase | |
| beta galactosidase (lacZ) (i.e., from *E. coli*) | |
| beta glucuronidase (gusA) | |
| thymidine phosphorylase | |
| deoxycytidine kinase | |
| linamerase | |
| Proteins detectable by antibodies | |
| chloramphenicol acetyl transferase | |
| hGH | |
| Viral attenuation factors | |
| virus-specific antibodies | |
| mucins | |
| thrombospondin | |
| tumor necrosis factors (TNFs) | |
| TNFα | |
| Superantigens | |
| Toxins | |
| diphtheria toxin | |
| *Pseudomonas* exotoxin | |
| *Escherichia coli* Shiga toxin | |
| *Shigella* toxin | |
| *Escherichia coli* Verotoxin 1 | |
| Toxic Shock Syndrome Toxin 1 | |
| Exfoliating Toxins (EXft) | |
| Streptococcal Pyrogenic Exotoxin (SPE) A, B and C | |
| Clostridial *Perfringens* Enterotoxin (CPET) | |

TABLE 5-continued

| Detectable gene products | SEQ ID NO |
|---|---|
| staphylococcal enterotoxins | |
| SEA, SEB, SEC1, SEC2, SED, SEE and SEH | |
| Mouse Mammary Tumor Virus proteins (MMTV) | |
| Streptococcal M proteins | |
| *Listeria monocytogenes* antigen p60 | |
| mycoplasma arthritis superantigens | |
| Proteins that can bind a contrasting agent, chromophore, or a compound or ligand that can be detected | |
| siderophores | |
| enterobactin | |
| salmochelin | |
| yersiniabactin | |
| aerobactin | |
| Growth Factors | |
| platelet-derived growth factor (PDG-F) | |
| keratinocyte growth factor (KGF) | |
| insulin-like growth factor-1 (IGF-1) | |
| insulin-like growth factor-binding proteins (IGFBPs) | |
| transforming growth factor (TGF-alpha) | |
| Growth factors for blood cells | |
| Granulocyte Colony Stimulating Factor (G-CSF) | |
| growth factors that can boost platelets | |
| Other Groups | |
| BAC (Bacterial Artificial Chromosome) encoding several or all proteins of a specific pathway, e.g. woundhealing-pathway | |
| MAC (Mammalian Artificial Chromosome) encoding several or all proteins of a specific pathway, e.g. woundhealing-pathway | |
| tumor antigen | |
| RNAi | |
| ligand binding proteins | |
| proteins that can induce a signal detectable by MRI | |
| angiogenins | |
| photosensitizing agents | |
| anti-metabolites | |
| signaling modulators | |
| chemotherapeutic compounds | |
| lipases | |
| proteases | |
| pro-apoptotic factors | |
| anti-cancer vaccine | |
| antigen vaccines | |
| whole cell vaccines (i.e., dendritic cell vaccines) | |
| DNA vaccines | |
| anti-idiotype vaccines | |
| tumor suppressors | |
| cytotoxic protein | |
| cytostatic proteins | |
| costimulatory molecules | |
| cytokines and chemokines | |
| cancer growth inhibitors | |
| gene therapy | |
| BCG vaccine for bladder cancer | |
| Proteins that interact with host cell proteins | |

2. Exemplary Modifications a. Diagnostic Gene Products

In some examples, the viruses provided herein can express one or more additional genes whose products are detectable or whose products are capable of inducing a detectable signal. In some examples, the viruses provided herein contain nucleic acid that encodes a detectable protein or a protein capable of inducing a detectable signal. Expression of such proteins allows detection of the virus in vitro and in vivo. A variety of detectable gene products, such as detectable proteins are known in the art, and can be used with the viruses provided herein.

Exemplary of such proteins are enzymes that can catalyze a detectable reaction or catalyze formation of a detectable product, such as, for example, luciferases, such as a click beetle luciferase, a *Renilla* luciferase, a firefly luciferase or beta-glucoronidase (GusA). Also exemplary of such proteins are proteins that emit a detectable signal, including fluorescent proteins, such as a green fluorescent protein (GFP) or a red fluorescent protein (RFP). A variety of DNA sequences encoding proteins that can emit a detectable signal or that can catalyze a detectable reaction, such as luminescent or fluorescent proteins, are known and can be used in the viruses and methods provided herein. Exemplary genes encoding light-emitting proteins include, for example, genes from bacterial luciferase from *Vibrio harveyi* (Belas et al., *Science* 218 (1982), 791-793), bacterial luciferase from *Vibrio fischerii* (Foran and Brown, *Nucleic acids Res.* 16 (1988), 177), firefly luciferase (de Wet et al., *Mol. Cell. Biol.*

7 (1987), 725-737), aequorin from *Aequorea victoria* (Prasher et al., *Biochem.* 26 (1987), 1326-1332), *Renilla* luciferase from *Renilla renformis* (Lorenz et al, *PNAS USA* 88 (1991), 4438-4442) and green fluorescent protein from *Aequorea victoria* (Prasher et al., *Gene* 111: 229-233 (1987)). The luxA and luxB genes of bacterial luciferase can be fused to produce the fusion gene ($Fab_2$), which can be expressed to produce a fully functional luciferase protein (Escher et al., *PNAS* 86: 6528-6532 (1989)). Transformation and expression of these genes in viruses can permit detection of viral infection, for example, using a low light and/or fluorescence imaging camera. In some examples, luciferases expressed by viruses can require exogenously added substrates such as decanal or coelenterazine for light emission. In other examples, viruses can express a complete lux operon, which can include proteins that can provide luciferase substrates such as decanal. For example, viruses containing the complete lux operon sequence, when injected intraperitoneally, intramuscularly, or intravenously, allowed the visualization and localization of microorganisms in live mice indicating that the luciferase light emission can penetrate the tissues and can be detected externally (Contag et al. (1995) *Mol. Microbiol.* 18: 593-603).

Exemplary detectable proteins also include proteins that can bind a contrasting agent, chromophore, or a compound or ligand that can be detected, such as a transferrin receptor or a ferritin; and reporter proteins, such as *E. coli* β-galactosidase, β-glucuronidase, xanthine-guanine phosphoribosyltransferase (gpt).

Also exemplary of detectable proteins are gene products that can specifically bind a detectable compound, including, but not limited to receptors, metal binding proteins (e.g., siderophores, ferritins, transferrin receptors), ligand binding proteins, and antibodies. Also exemplary of detectable proteins are transporter proteins that can bind to and transport detectable molecules. Such molecules can be used for detection of the virus, such as for applications involving imaging. Any of a variety of detectable compounds can be used, and can be imaged by any of a variety of known imaging methods. Exemplary compounds include receptor ligands and antigens for antibodies. The ligand can be labeled according to the imaging method to be used. Exemplary imaging methods include, but are not limited to, X-rays, magnetic resonance methods, such as magnetic resonance imaging (MRI) and magnetic resonance spectroscopy (MRS), and tomographic methods, including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography.

Labels appropriate for X-ray imaging are known in the art, and include, for example, Bismuth (III), Gold (III), Lanthanum (III) or Lead (II); a radioactive ion, such as $^{67}$Copper, $^{67}$Gallium, $^{68}$Gallium, $^{111}$Indium, $^{113}$Indium, $^{123}$Iodine, $^{125}$Iodine, $^{131}$Iodine, $^{197}$Mercury, $^{203}$Mercury, $^{186}$Rhenium, $^{188}$Rhenium, $^{97}$Rubidium, $^{103}$Rubidium, $^{99}$Technetium or $^{90}$Yttrium; a nuclear magnetic spin-resonance isotope, such as Cobalt (II), Copper (II), Chromium (III), Dysprosium (III), Erbium (III), Gadolinium (III), Holmium (III), Iron (II), Iron (III), Manganese (II), Neodymium (III), Nickel (II), Samarium (III), Terbium (III), Vanadium (II) or Ytterbium (III); or rhodamine or fluorescein.

Labels appropriate for magnetic resonance imaging are known in the art, and include, for example, gadolinium chelates and iron oxides. Use of chelates in contrast agents is known in the art. Labels appropriate for tomographic imaging methods are known in the art, and include, for example, β-emitters such as $^{11}$C, $^{13}$N, $^{15}$O or $^{64}$Cu or γ-emitters such as $^{123}$I. Other exemplary radionuclides that can, be used, for example, as tracers for PET include $^{55}$Co, $^{67}$Ga, $^{68}$Ga, $^{60}$Cu(II), $^{67}$Cu(II), $^{57}$Ni, $^{52}$Fe and $^{18}$F (e.g., $^{18}$F-fluorodeoxyglucose (FDG)). Examples of useful radionuclide-labeled agents are a $^{64}$Cu-labeled engineered antibody fragment (Wu et al. (2002) *PNAS USA* 97: 8495-8500), $^{64}$Cu-labeled somatostatin (Lewis et al. (1999) *J. Med. Chem.* 42: 1341-1347), $^{64}$Cu-pyruvaldehyde-bis(N4-methylthiosemicarbazone)($^{64}$Cu-PTSM) (Adonai et al. (2002) *PNAS USA* 99: 3030-3035), $^{52}$Fe-citrate (Leenders et al. (1994) *J. Neural. Transm. Suppl.* 43: 123-132), $^{52}$Fe/$^{52m}$Mn-citrate (Calonder et al. (1999) *J. Neurochem.* 73: 2047-2055) and $^{52}$Fe-labeled iron (III) hydroxide-sucrose complex (Beshara et al. (1999) *Br. J. Haematol.* 104: 288-295, 296-302).

Exemplary of detectable proteins are transporter proteins that can bind to and transport detectable molecules, such as human epinephrine transporter (hNET) or sodium iodide symporter (NIS) that can bind to and transport detectable molecules, such as MIBG and other labeled molecules (e.g., $Na^{125}I$), into the cell.

Other exemplary detectable proteins are proteins encoded by genes for melanin synthesis. Many genes are known to be involved in melanin biosynthesis (see e.g. Simon et al. (2009) Pigment Cell Melanoma Res, 22:563-79). Melanin is a pigment that can be subdivided into the brownish/black eumelanin and the reddish brown pheomelanin. Exemplary of such genes include, but are not limited to, mouse tyrosinase (mTYR), human tyrosinase related protein 1 (tyrp1) and human Dopachrome tautomerase/tyrosinase related protein 2 (DC2). A virus expressing a gene for melanin synthesis can be used to infect hosts or cells to obtain cells with high light absorption rates over the whole visible spectrum. The resulting cells or animals can be imaged using any imaging system capable of detecting high light absorption rates over the whole visible spectrum and/or across different penetration scales. For example, a (multispectral) photo-/optoacoustic tomography—(MS)OAT can be used (see e.g. Ntziachristos (2010) *Nature Methods*, 7:603-14; Li et al. (2007) *J Biomed Optics Letters*, 12:1-3).

The viruses can be modified for purposes of using the viruses for imaging, including for the purpose of dual imaging in vitro and/or in vivo to detect two or more detectable gene products, gene products that produce a detectable signal, gene products that can bind a detectable compound, or gene products that can bind other molecules to form a detectable product. In some examples, the two or more gene products are expressed by different viruses, whereas in other examples the two or more gene products are produced by the same virus. For example, a virus can express a gene product that emits a detectable signal and also express a gene product that catalyzes a detectable reaction. In other examples, a virus can express one or more gene products that emit a detectable signal, one or more gene products that catalyze a detectable reaction, one or more gene products that can bind a detectable compound or that can form a detectable product, or any combination thereof. Any combination of such gene products can be expressed by the viruses provided herein and can be used in combination with any of the methods provided herein. Imaging of such gene products can be performed, for example, by various imaging methods as described herein and known in the art (e.g., fluorescence imaging, MRI, PET, among many other methods of detection). Imaging of gene products can also be performed using the same method, whereby gene products are distinguished by their properties, such as by differences in wavelengths of light emitted. For example, a virus can express more than one fluorescent protein that differs in the wavelength of light emitted (e.g., a GFP and an RFP). In another non-limiting example, an RFP can be expressed with a luciferase. In yet other non-limiting examples, a fluorescent gene product can be expressed with a gene product, such as a ferritin or a transferrin receptor, used for magnetic resonance imaging. A virus expressing two or more detectable gene products or two or more viruses expressing two or more detectable gene products can be imaged in vitro or in vivo using such methods. In some examples the two or more gene products are expressed as a single polypeptide, such as a fusion protein. For example a fluorescent protein can be expressed as a fusion protein with a luciferase protein.

b. Therapeutic Gene Products

Viruses provided herein also can contain a heterologous nucleic arid molecule that encodes one or more therapeutic gene products. Therapeutic gene products include products that cause cell death or cause an anti-tumor immune response. A variety of therapeutic gene products, such as toxic or apoptotic proteins, or siRNA, are known in the art, and can be used with the viruses provided herein. The therapeutic genes can act by directly killing the host cell, for example, as a channel-forming or other lytic protein, or by triggering apoptosis, or by inhibiting essential cellular processes, or by triggering an immune response against the cell, or by interacting with a compound that has a similar effect, for example, by converting a less active compound to a cytotoxic compound.

Exemplary therapeutic gene products that can be expressed by the viruses provided herein include, but are not limited to, gene products (i.e., proteins and RNAs), including those useful for tumor therapy, such as, but not limited to, an anticancer agent, an antimetastatic agent, or an anti-angiogenic agent. For example, exemplary proteins useful for tumor therapy include, but are not limited to, tumor suppressors, cytostatic proteins and costimulatory molecules, such as a cytokine, a chemokine, or other immunomodulatory molecules, an anticancer antibody, such as a single-chain antibody, antisense RNA, siRNA, prodrug converting enzyme, a toxin, a mitosis inhibitor protein, an antitumor oligopeptide, an anticancer polypeptide antibiotic, an angiogenesis inhibitor, or tissue factor. For example, a large number of therapeutic proteins that can be expressed for tumor treatment in the viruses and methods provided herein are known in the art, including, but not limited to, a transporter, a cell-surface receptor, a cytokine, a chemokine, an apoptotic protein, a mitosis inhibitor protein, an antimitotic oligopeptide, an antiangiogenic factor (e.g., hk5), angiogenesis inhibitors (e.g., plasminogen kringle 5 domain, anti-vascular endothelial growth factor (VEGF) scAb, tTF-RGD, truncated human tissue factor-$α_v β_3$-integrin RGD peptide fusion protein), anticancer antibodies, such as a single-chain antibody (e.g., an antitumor antibody or an antiangiogenic antibody, such as an anti-VEGF antibody or an anti-epidermal growth factor receptor (EGFR) antibody), a toxin, a tumor antigen, a prodrug converting enzyme, a ribozyme, RNAi, and siRNA.

Costimulatory molecules for the methods provided herein include any molecules which are capable of enhancing immune responses to an antigen/pathogen in vivo and/or in vitro. Costimulatory molecules also encompass any molecules which promote the activation, proliferation, differentiation, maturation or maintenance of lymphocytes and/or other cells whose function is important or essential for immune responses.

An exemplary, non-limiting list of therapeutic proteins includes tumor growth suppressors such as IL-24, WT1, p53, pseudomonas A endotoxin, diphtheria toxin, Arf, Bax, HSV TK, *E. coli* purine nucleoside phosphorylase, angiostatin and endostatin, p16, Rb, BRCA1, cystic fibrosis transmembrane regulator (CFTR), Factor VIII, low density lipoprotein receptor, beta-galactosidase, alpha-galactosidase, beta-glucocerebrosidase, insulin, parathyroid hormone, alpha-1-antitrypsin, rsCD40L, Fas-ligand, TRAIL, TNF, antibodies, microcin E492, diphtheria toxin, *Pseudomonas* exotoxin, *Escherichia coli* Shiga toxin, *Escherichia coli* Verotoxin 1, and hyperforin. Exemplary cytokines include, but are not limited to, chemokines and classical cytokines, such as the interleukins, including for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factor (GM-CSF), erythropoietin and exemplary chemokines including, but not limited to CXC chemokines such as IL-8 GROα, GROβ, GROγ, ENA-78, LDGF-PBP, GCP-2, PF4, Mig, IP-10, SDF-1α/β, BUNZO/STRC33, I-TAC, BLC/BCA-1; CC chemokines such as MIP-1α, MIP-1β, MDC, TECK, TARC, RANTES, HCC-1, HCC-4, DC-CK1, MIP-3α, MIP-3β, MCP-1, MCP-2, MCP-3, MCP-4, Eotaxin, Eotaxin-2/MPIF-2, I-309, MIP-5/HCC-2, MPIF-1, 6Ckine, CTACK, MEC; lymphotactin; and fractalkine. Exemplary other costimulatory molecules include immunoglobulin superfamily of cytokines, such as B7.1, B7.2.

Exemplary therapeutic proteins that can be expressed by the viruses provided herein and used in the methods provided herein include, but are not limited to, erythropoietin (e.g., SEQ ID NO: 329), an anti-VEGF single chain antibody (e.g., SEQ ID NO: 21), a plasminogen K5 domain (e.g., SEQ ID NO: 190), a human tissue factor-αvβ3-integrin RGD fusion protein (e.g., SEQ ID NO: 14), interleukin-24 (e.g., SEQ ID NO: 98), or immune stimulators, such as SIL-6-SIL-6 receptor fusion protein (e.g., SEQ ID NO: 97).

In some examples, the viruses provided herein can express one or more therapeutic gene products that are proteins that convert a less active compound into a compound that causes tumor cell death. Exemplary methods of conversion of such a prodrug compound include enzymatic conversion and photolytic conversion. A large variety of protein/compound pairs are known in the art, and include, but are not limited to, Herpes simplex virus thymidine kinase/ganciclovir, Herpes simplex virus thymidine kinase/(E)-5-(2-bromovinyl)-2'-deoxyuridine (BVDU), varicella zoster thymidine kinase/ganciclovir, varicella zoster thymidine kinase/BVDU, varicella zoster thymidine kinase/(E)-5-(2-bromovinyl)-1-beta-D-arabinofuranosyluracil (BVaraU), cytosine deaminase/5-fluorouracil, cytosine deaminase/5-fluorocytosine, purine nucleoside phosphorylase/6-methylpurine deoxyriboside, beta lactamase/cephalosporin-doxorubicin, carboxypeptidase G2/4-[(2-chloroethyl)(2-mesyloxyethyl)amino]benzoyl-L-glutamic acid (CMDA), carboxypeptidase A/methotrexate-phenylamine, cytochrome P450/acetominophen, cytochrome P450-2B1/cyclophosphamide, cytochrome P450-4B1/2-aminoanthracene, 4-ipomeanol, horseradish peroxidase/indole-3-acetic acid, nitroreductase/CB1954, rabbit carboxylesterase/7-ethyl-10-[4-(1-piperidino)-1-piperidino]carbonyloxy-camptothecin (CPT-11), mushroom tyrosinase/bis-(2-chloroethyl) amino-4-hydroxyphenylaminomethanone 28, beta galactosidase/1-chloromethyl-5-hydroxy-1,2-dihydro-3H-benz[e]indole, beta glucuronidase/epirubicin glucuronide, thymidine phosphorylase/5'-deoxy-5-fluorouridine, deoxycytidine kinase/cytosine arabinoside, and linamerase/linamarin.

Other therapeutic gene products that can be expressed by the viruses provided herein include siRNA and microRNA molecules. The siRNA and/or microRNA molecule can be directed against expression of a tumor-promoting gene, such as, but not limited to, an oncogene, growth factor, angiogenesis promoting gene, or a receptor. The siRNA and/or microRNA molecule also can be directed against expression of any gene essential for cell growth, cell replication or cell survival. The siRNA and/or microRNA molecule also can be directed against expression of any gene that stabilizes the cell membrane or otherwise limits the number of tumor cell antigens released from the tumor cell. Design of an siRNA or microRNA can be readily determined according to the selected target of the siRNA; methods of siRNA and microRNA design and down-regulation of genes are known in the art, as exemplified in U.S. Pat. Pub. Nos. 2003-0198627 and 2007-0044164, and Zeng et al., Molecular Cell 9:1327-1333 (2002).

Therapeutic gene products include viral attenuation factors, such as antiviral proteins. Antiviral proteins or peptides can be expressed by the viruses provided herein. Expression of antiviral proteins or peptides can control viral pathogenicity. Exemplary viral attenuation factors include, but are not limited to, virus-specific antibodies, mucins, thrombospondin, and soluble proteins such as cytokines, including, but not limited to TNFα, interferons (for example IFNα, IFNβ, or IFNγ) and interleukins (for example IL-1, IL-12 or IL-18).

Another exemplary therapeutic gene product that can be expressed by the viruses provided herein is a protein ligand, such as antitumor oligopeptide. Antitumor oligopeptides are short protein peptides with high affinity and specificity to tumors. Such oligopeptides could be enriched and identified using tumor-associated phage libraries (Akita et al. (2006) Cancer Sci. 97(10):1075-1081). These oligopeptides have been shown to enhance chemotherapy (U.S. Pat. No. 4,912,199). The oligopeptides can be expressed by the viruses provided herein. Expression of the oligopeptides can elicit anticancer activities on their own or in combination with other chemotherapeutic agents. An exemplary group of antitumor oligopeptides is antimitotic peptides, including, but not limited to, tubulysin (Khalil et al. (2006) Chembiochem. 7(4):678-683), phomopsin, hemiasterlin, taltobulin (HTI-286, 3), and cryptophycin. Tubulysin is from myxobacteria and can induce depletion of cell microtubules and trigger the apoptotic process. The antimitotic peptides can be expressed by the viruses provide herein and elicit anticancer activities on their own or in combination with other therapeutic modalities.

Another exemplary therapeutic gene product that can be expressed by the viruses provided herein is a protein that sequesters molecules or nutrients needed for tumor growth. For example, the virus can express one or more proteins that bind iron, transport iron, or store iron, or a combination thereof. Increased iron uptake and/or storage by expression of such proteins not only, increases contrast for visualization and detection of a tumor or tissue in which the virus accumulates, but also depletes iron from the tumor environment. Iron depletion from the tumor environment removes a vital nutrient from the tumors, thereby deregulating iron hemostasis in tumor cells and delaying tumor progression and/or killing the tumor.

Additionally, iron, or other labeled metals, can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Internalization of iron in the tumor, wound, area of inflammation or infection allows the internalization of iron alone, a supplemental imaging moiety, or a therapeutic agent (which can deliver cytotoxicity specifically to tumor cells or deliver the therapeutic agent for treatment of the wound, area of inflammation or infection). These methods can be combined with any of the other methods provided herein.

c. Antigens

The viruses provided herein can be modified to express one or more antigens. Exemplary antigens include, but are not limited to, tumor specific antigens, tumor-associated antigens, tissue-specific antigens, bacterial antigens, viral antigens, yeast antigens, fungal antigens, protozoan antigens, parasite antigens and mitogens. Superantigens are antigens that can activate a large immune response, often brought about by a large response of T cells. A variety of superantigens are known in the art including, but not limited to, diphtheria toxin, staphylococcal enterotoxins (SEA, SEB, SEC1, SEC2, SED, SEE and SEH), Toxic Shock Syndrome Toxin 1, Exfoliating Toxins (EXft), Streptococcal Pyrogenic Exotoxin A, B and C(SPE A, B and C), Mouse Mammary Tumor Virus proteins (MMTV), Streptococcal M proteins, Clostridial Perfringens Enterotoxin (CPET), *Listeria monocytogenes* antigen p60, and mycoplasma arthritis superantigens.

Since many superantigens also are toxins, if expression of a virus of reduced toxicity is desired, the superantigen can be modified to retain at least some of its superantigenicity while reducing its toxicity, resulting in a compound such as a toxoid. A variety of recombinant superantigens and toxoids of superantigens are known in the art, and can readily be expressed in the viruses provided herein. Exemplary toxoids include toxoids of diphtheria toxin, as exemplified in U.S. Pat. No. 6,455,673 and toxoids of Staphylococcal enterotoxins, as exemplified in U.S. Pat. Pub. No. 2003-0009015.

d. Modifications to Alter Attenuation of the Viruses

Viruses provided herein can be further attenuated by addition, deletion and/or modification of nucleic acid in the viral genome. In one example, the virus is attenuated by addition of heterologous nucleic acid that contains an open reading frame that encodes one or more gene products (e.g. a diagnostic gene product or a therapeutic gene product as described elsewhere herein). In another example, the virus is attenuated by modification of heterologous nucleic acid that contains an open reading frame that encodes one or more gene products. In a further example, the heterologous nucleic acid is modified by increasing the length of the open reading frame, removal of all or part of the open reading frame or replacement of all or part of the open reading frame. Such modifications can affect viral toxicity by disruption of one or more viral genes or by increasing or decreasing the transcriptional and/or translational load on the virus (see, e.g., International Patent Publication No. WO 2008/100292).

In another example, the virus can be attenuated by modification or replacement of one or more promoters contained in the virus. Such promoters can be replaced by stronger or weaker promoters, where replacement results in a change in the attenuation of the virus. In one example, a promoter of a virus provided herein is replaced with a natural promoter. In one example, a promoter of a virus provided herein is replaced with a synthetic promoter. Exemplary promoters that can replace a promoter contained in a virus can be a viral promoter, such as a vaccinia viral promoter, and can include a vaccinia early, intermediate, early/late or late promoter. Additional exemplary viral promoters are provided herein and known in the art and can be used to replace a promoter contained in a virus.

In another example, the virus can be attenuated by removal or all or a portion of a heterologous nucleic acid molecule contained in the virus. The portion of the heterologous nucleic acid that is removed can be 1, 2, 3, 4, 5 or more, 10 or more, 15 or more, 20 or more, 50 or more, 100 or more, 1000 or more, 5000 or more nucleotide bases. In another example, the virus is attenuated by modification of a heterologous nucleic acid contained in the virus by removal or all or a portion of a first heterologous nucleic acid molecule and replacement by a second heterologous nucleic acid molecule, where replacement changes the level of attenuation of the virus. The second heterologous nucleic acid molecule can contain a sequence of nucleotides that encodes a protein or can be a non-coding nucleic acid molecule. In some examples, the second heterologous nucleic acid molecule contains an open reading frame operably linked to a promoter. The second heterologous nucleic acid molecule can contain one or more open reading frames or one or more promoters. Further, the one or more promoters of the second heterologous nucleic acid molecule can be one or more stronger promoters or one or more weaker promoters, or can be a combination or both.

Attenuated vaccinia viruses are known in the art and are described, for example, in U.S. Patent Pub. Nos. US 2005-0031643 now U.S. Pat. Nos. 7,588,767, 7,588,771 and 7,662,398, US 2008-0193373, US 2009-0098529, US 2009-0053244, US 2009-0155287, US 2009-0081639, US 2009-0117034 and US 2009-0136917, and International Patent Pub. Nos. WO 2005/047458, WO 2008/100292 and WO 2008/150496.

Viruses provided herein also can contain a modification that alters its infectivity or resistance to neutralizing antibodies. In one non-limiting example deletion of the A35R gene in a vaccinia LIVP strain can decrease the infectivity of the virus. In some examples, the viruses provided herein can be modified to contain a deletion of the A35R gene. Exemplary methods for generating such viruses are described in PCT Publication No. WO2008/100292, which describes vaccinia LIVP viruses GLV-1j87, GLV-1j88 and GLV-1j89, which contain deletion of the A35R gene.

In another non-limiting example, replacement of viral coat proteins (e.g., A34R, which encodes a viral coat glycoprotein) with coat proteins from either more virulent or less virulent virus strains can increase or decrease the clearance of the virus from the subject. In one example, the A34R gene in an vaccinia LIVP strain can be replaced with the A34R gene from vaccinia IHD-J strain. Such replacement can increase the extracellular enveloped virus (EEV) form of vaccinia virus and can increase the resistance of the virus to neutralizing antibodies.

3. Control of Heterologous Gene Expression

In some examples, the heterologous nucleic acid also can contain one or more regulatory sequences to regulate expression of an open reading frame encoding the heterologous RNA and/or protein. Suitable regulatory sequences which, for example, are functional in a mammalian host cell are well known in the art. Expression can also be influenced by one or more proteins or RNA molecules expressed by the virus. Gene regulatory elements, such as promoters and enhancers, possess cell type specific activities and can be activated by certain induction factors (e.g., hormones, growth factors, cytokines, cytostatic agents, irradiation, heat shock) via responsive elements. A controlled and restricted expression of these genes can be achieved using such regulatory elements as internal promoters to drive the expression of therapeutic genes in viral vector constructs.

For example, the one or more heterologous nucleic acid molecules can be operably linked to a promoter for expression of the heterologous RNA and/or protein. For example, a heterologous nucleic acid that is operably linked to a promoter is also called an expression cassette. Hence, viruses provided herein can have the ability to express one or more heterologous genes. Gene expression can include expression of a protein encoded by a gene and/or expression of an RNA molecule encoded by a gene. In some embodiments, the viruses provided herein can express exogenous genes at levels high enough that permit harvesting products of the exogenous genes from the tumor. Expression of heterologous genes can be controlled by a constitutive promoter, or by an inducible promoter. In other examples, organ or tissue-specific expression can be controlled by regulatory sequences. In order to achieve expression only in the target organ, for example, a tumor to be treated, the foreign nucleotide sequence can be linked to a tissue specific promoter and used for gene therapy. Such promoters are well known to those skilled in the art (see, e.g., Zimmermann et al., *Neuron* 12: 11-24 (1994); Vidal et al., *EMBO J.* 9: 833-840 (1990); Mayford et al., *Cell* 81: 891-904 (1995); and Pinkert et al., *Genes & Dev.* 1: 268-76 (1987)).

Exemplary promoters for the expression of heterologous genes are known in the art. The heterologous nucleic acid can be operatively linked to a native promoter or a heterologous promoter that is not native to the virus. Any suitable promoters, including synthetic and naturally-occurring and modified promoters, can be used. Exemplary promoters include synthetic promoters, including synthetic viral and animal promoters. Native promoter or heterologous promoters include, but are not limited to, viral promoters, such as vaccinia virus and adenovirus promoters.

In one example, the promoter is a poxvirus promoter, such as, for example, a vaccinia virus promoter. Vaccinia viral promoters for the expression of one or more heterologous genes can be synthetic or natural promoters, and include vaccinia early, intermediate, early/late and late promoters. Exemplary vaccinia viral promoters for controlling heterologous gene expression include, but are not limited to, $P_{7.5k}$, $P_{11k}$, $P_{SE}$, $P_{SEL}$, $P_{SL}$, H5R, TK, P28, C11R, G8R, F17R, I3L, I8R, A1L, A2L, A3L, H1L, H3L, H5L, H6R, H8R, D1R, D4R, D5R, D9R, D11L, D12L, D13L, M1L, N2L, P4b or K1 promoters. Other viral promoters include, but are not limited to, adenovirus late promoter, Cowpox ATI promoter, or T7 promoter. Strong late promoters can be used to achieve high levels of expression of the heterologous genes. Early and intermediate-stage promoters also can be used. In one example, the promoters contain early and late promoter elements, for example, the vaccinia virus early/late promoter $P_{7.5k}$, vaccinia late promoter $P_{11k}$, a synthetic early/late vaccinia $P_{SEL}$ promoter (Patel et al., (1988) *Proc. Natl. Acad. Sci. USA* 85: 9431-9435; Davison and Moss, (1989) *J Mol Biol* 210: 749-769; Davison et al. (1990) *Nucleic Acids Res.* 18: 4285-4286; Chakrabarti et al. (1997), *BioTechniques* 23: 1094-1097). The viruses provided herein can exhibit differences in characteristics, such as attenuation, as a result of using a stronger promoter versus a weaker promoter. For example, in vaccinia, synthetic early/late and late promoters are relatively strong promoters, whereas vaccinia synthetic early, $P_{7.5k}$ early/late, $P_{7.5k}$ early, and $P_{28}$ late promoters are relatively weaker promoters (see e.g., Chakrabarti et al. (1997) *BioTechniques* 23(6) 1094-1097).

Combinations of different promoters can be used to express different gene products in the same virus or two different viruses.

As is known in the art, regulatory sequences can permit constitutive expression of the exogenous gene or can permit inducible expression of the exogenous gene. Further, the regulatory sequence can permit control of the level of expression of the exogenous gene. In some examples, such as gene product manufacture and harvesting, the regulatory sequence can result in constitutive, high levels of gene expression. In some examples, such as anti-(gene product) antibody harvesting, the regulatory sequence can result in constitutive, lower levels of gene expression. In tumor therapy examples, a therapeutic protein can be under the control of an internally inducible promoter or an externally inducible promoter.

Hence, expression of heterologous genes can be controlled by a constitutive promoter or by an inducible promoter. Inducible promoters can be used to provide tissue specific expression of the heterologous gene or can be inducible by the addition of a regulatory molecule to provide temporal specific induction of the promoter. In some examples, inducible expression can be under the control of cellular or other factors present in a tumor cell or present in a virus-infected tumor cell. In further examples, inducible expression can be under the control of an administrable substance, including IPTG, RU486 or other known induction compounds. Additional regulatory sequences can be used to control the expression of the one or more heterologous genes inserted the virus. Any of a variety of regulatory sequences are available to one skilled in the art according to known factors and design preferences.

4. Methods for Generating Modified Viruses

The viruses provided herein can be modified by insertion, deletion, replacement or mutation as described herein, for example insertion or replacement of heterologous nucleic. acid, using standard methodologies well known in the art for modifying viruses. Methods for modification include, for example, in vitro recombination techniques, synthetic methods, direct cloning, and in vivo recombination methods as described, for example, in Sambrook et al., Molecular Cloning: A Laboratory Manual, 2nd edition, Cold Spring Harbor Laboratory Press, cold Spring Harbor N.Y. (1989), and in the Examples disclosed herein.

For example, generation of recombinant viruses, including recombinant poxviruses, is well known in the art, and typically involves the generation of gene cassettes or transfer vectors using standard techniques in molecular biology (see, e.g., U.S. Pat. No. 7,588,767 and US2009-0053244-A1, which describe exemplary methods of generating recombinant LIVP vaccinia viruses). Such techniques include various nucleic acid manipulation techniques, nucleic acid transfer protocols, nucleic acid amplification protocols, and other molecular biology techniques known in the art. For example, point mutations or small insertions or deletions can be introduced into a gene of interest through the use of oligonucleotide mediated site-directed mutagenesis. In another example, homologous recombination can be used to introduce a mutation in the nucleic acid sequence or insertion or deletion of a nucleic acid molecule into a target sequence of interest. In some examples, mutations, insertions or deletions of nucleic acid in a particular gene can be selected for using a positive or negative selection pressure. See, e.g., Current Techniques in Molecular Biology, (Ed. Ausubel, et al.). Nucleic acid amplification protocols include, but are not limited to, the polymerase chain reaction (PCR), or amplification via viruses or organisms, such as, but not limited to, bacteria, yeast, insect or mammalian cells. Use of nucleic acid tools such as plasmids, vectors, promoters and other regulating sequences, are well known in the art for a large variety of viruses and cellular organisms. Nucleic acid transfer protocols include calcium chloride transformation/transfection, electroporation, liposome mediated nucleic acid transfer, N-[1-(2,3-dioloyloxy)propyl]-N,N,N-trimethylammonium methylsulfate meditated transformation, and others. Further a large variety of nucleic acid tools are available from many different sources, including various commercial sources. One skilled in the art will be readily able to select the appropriate tools and methods for genetic modifications of any particular virus according to the knowledge in the art and design choice.

Hence, any of a variety of modifications can be readily accomplished using standard molecular biological methods known in the art. The modifications will typically be one or more truncations, deletions, mutations or insertions of the viral genome. In one example, the modification can be specifically directed to a particular sequence in the viral genome. The modifications can be directed to any of a variety of regions of the viral genome, including, but not limited to, a regulatory sequence, a gene-encoding sequence, an intergenic sequence, a sequence without a known role, or a non-essential region of the viral genome. Any of a variety of regions of viral genomes that are available for modification are readily known in the art for many viruses, including LIVP.

Heterologous nucleic acid molecules are typically inserted into the viral genome in an intergenic region or in a locus that encodes a nonessential viral gene product. Insertion of heterologous nucleic acid at such sites generally does not significantly affect viral infection or replication in the target tissue. Exemplary insertion sites are known in the art and include, but are not limited to, J2R (thymidine kinase (TK)), A56R (hemagglutinin (HA)), F14.5L, vaccinia growth factor (VGF), A35R, N1L, E2L/E3L, K1L/K2L, superoxide dismutase locus, 7.5K, C7-K1L (host range gene region), B13R+B14R (hemorrhagic region), A26L (A type inclusion body region (ATI)) or I4L (large subunit, ribonucleotide reductase) gene loci. Insertion sites for the viruses provided herein also include sites that correspond to intragenic regions described in other poxviruses such as Modified Vaccinia Ankara (MVA) virus (exemplary sites set forth in U.S. Pat. No. 7,550,147), NYVAC (exemplary sites set forth in U.S. Pat. No. 5,762,938).

Methods for the generation of recombinant viruses using recombinant DNA techniques are well known in the art (e.g., see U.S. Pat. Nos. 4,769,330; 4,603,112; 4,722,848; 4,215, 051; 5,110,587; 5,174,993; 5,922,576; 6,319,703; 5,719, 054; 6,429,001; 6,589,531; 6,573,090; 6,800,288; 7,045, 313; He et al. (1998) *PNAS* 95(5): 2509-2514; Racaniello et al., (1981) *Science* 214: 916-919; and Hruby et al., (1990) *Clin Micro Rev.* 3:153-170). Methods for the generation of recombinant vaccinia viruses are well known in the art (e.g., see Hruby et al., (1990) *Clin Micro Rev.* 3:153-170, U.S. Pat. Pub. No. 2005-0031643, now U.S. Pat. Nos. 7,588,767, 7,588,771, 7,662,398 and 7,045,313).

For example, generating a recombinant vaccinia virus that expresses a heterologous gene product typically includes the use of a recombination plasmid which contains the heterologous nucleic acid, optionally operably linked to a promoter, with vaccinia virus DNA sequences flanking the heterologous nucleic acid to facilitate homologous recombination and insertion of the gene into the viral genome. Generally, the viral DNA flanking the heterologous gene is complementary to a non-essential segment of vaccinia virus DNA, such that the gene is inserted into a nonessential location. The recombination plasmid can be grown in and purified from *Escherichia coli* and introduced into suitable host cells, such as, for example, but not limited to, CV-1, BSC-40, BSC-1 and TK-143 cells. The transfected cells are then superinfected with vaccinia virus which initiates a replication cycle. The heterologous DNA can be incorporated into the vaccinia viral genome through homologous recombination, and packaged into infection progeny. The recombinant viruses can be identified by methods known in the art, such as by detection of the expression of the heterologous gene product, or by using positive or negative selection methods (U.S. Pat. No. 7,045,313).

In another example, the recombinant vaccinia virus that expresses a heterologous gene product can be generated by direct cloning (see, e.g. U.S. Pat. No. 6,265,183 and Scheiflinger et al. (1992) *Proc. Natl. Acad. Sci. USA* 89: 9977-9981). In such methods, the heterologous nucleic acid, optionally operably linked to a promoter, is flanked by restriction endonuclease cleavage sites for insertion into a unique restriction endonuclease site in the target virus. The virus DNA is purified using standard techniques and is cleaved with the sequence-specific restriction endonuclease, where the sequence is a unique site in the virus genome. Any unique site in the virus genome can be employed provided that modification at the site does not interfere with viral replication. For example, in vaccinia virus strain LIVP, the NotI restriction site is located in the ORF encoding the F14.5L gene with unknown function (Mikryukov et al., *Biotekhnologiya* 4: 442-449 (1988)). Table 6 provides a summary of unique restriction sites contained in exemplary LIVP strains and designates the nucleotide position of each. Such LIVP strains can be modified herein by direct cloning and insertion of heterologous DNA into the site or sites. Generally, insertion is in a site that is located in a non-essential region of the virus genome. For example, exemplary modifications herein include insertion of a foreign DNA sequence into the NotI digested virus DNA.

TABLE 6

Unique restriction endonuclease cleavage sites in LIVP clonal isolates

| Restriction Enzyme/ Site | 1.1.1 | 2.1.1 | 4.1.1 | 5.1.1 | 6.1.1 | 7.1.1 | 8.1.1 | GL-ONC-1 Parental |
|---|---|---|---|---|---|---|---|---|
| SbfI CCTGCAGG | 40033/40029 | 40756/40752 | 39977/39973 | 40576/40572 | 40177/40173 | 40213/40209 | 40493/40489 | 38630/38626 |
| NotI GCGGCCGC | 42989/42998 | 43712/43716 | 42933/42937 | 43532/43536 | 43133/43137 | 43169/43173 | 43449/43453 | 41586/41590 |
| SgrAI CRCCGGYG | 114365/114369 | 115107/115111 | 114308/114312 | 114924/114928 | 114489/114493 | 114548/114552 | 114845/114849 | 112975/112979 |
| SmaI CCCGGG | 159260 | NA | NA | NA | NA | NA | NA | NA |
| TspMI CCCGGG | 159258/159262 | NA | NA | NA | NA | NA | NA | NA |
| XmaI CCCGGG | 159258/159262 | NA | NA | NA | NA | NA | NA | NA |
| ApaI CCCGGG | 180516/180512 | NA | 180377/180373 | 181027/181023 | 180638/180634 | 180596/180592 | 180972/180968 | NA |
| PspOMI CCCGGG | 180512/180516 | NA | 180373/180377 | 181023/181027 | 180634/180638 | 180592/180596 | 180968/180972 | NA |

In some examples, the virus genomic DNA is first modified by homologous recombination to introduce one or more unique restriction sites in the virus (see, e.g. Mackett et al. (1984) *J. Virol.* 857-864). Following cleavage with the restriction endonuclease, the cleaved DNA is optionally treated with a phosphatase to remove a phosphate moiety from an end of the DNA segment that is produced by cleavage with the endonuclease. Typically, a plasmid vector is generated that contains the heterologous DNA for insertion flanked by the restriction sites. Prior to insertion into the virus, the heterologous DNA is excised from the plasmid by cleavage with the sequence specific restriction endonuclease. The heterologous DNA is then ligated to the cleaved viral DNA and is packaged in a permissive cell line by infection of the cells with a helper virus, such as, but not limited to a fowpox virus or a puv-inactivated helper vaccinia virus, and transfection of the ligated DNA into the infected cells.

In some examples, the methods involve homologous recombination and/or use., of unique restriction sites in the virus. For example, a recombinant LIVP vaccinia virus with an insertion, for example, in the F14.5L gene (e.g., in the Not I restriction site of an LIVP isolate) can be prepared by the following steps: (a) generating (i) a vaccinia shuttle/transfer plasmid containing the modification (e.g. a gene expression cassette or a modified F14.5L gene) inserted at a restriction site, X (e.g. Not I), where the restriction site in the vector is flanked by parental virus sequences of the target insertion site and (ii) an LIVP virus DNA digested at restriction site X (e.g. Not I) and optionally dephosphorylated; (b) infecting cells with PUV-inactivated helper vaccinia virus and transfecting the infected host cells with a mixture of the constructs of (i) and (ii) of step a; and (c) isolating the recombinant vaccinia viruses from the transfectants. One skilled in the art knows how to perform such methods (see, e.g., Timiryasova et al. (Biotechniques 31: 534-540 (2001)). Typically, the restriction site X is a unique restriction site in the virus as described above.

In one example, the methods include introducing into the viruses one or more genetic modifications, followed by screening the viruses for properties reflective of the modification or for other desired properties. In some examples, the modification can be fully or partially random, whereupon selection of any particular modified virus can be determined according to the desired properties of the modified the virus.

E. PROPAGATION AND PRODUCTION OF VIRUSES

Viruses provided herein can be produced by methods known to one of skill in the art. The resulting viruses provided herein can be used in therapeutic and diagnostic applications as described in Section F below.

The virus is propagated in host cells, quantified and prepared for storage before finally being prepared to use in the methods described herein. The virus can be propagated in suitable host cells to enlarge the stock, the concentration of which is then determined. In some examples, the infectious titer is determined, such as by plaque assay. The total number of viral particles also can be determined. The viruses are stored in conditions that promote stability and integrity of the virus, such that loss of infectivity over time is minimized. In some examples, a large amount of virus is produced and stored in small aliquots of known concentration that can be used for multiple procedures over an extended period of time. Conditions that are most suitable for various viruses will differ, and are known in the art, but typically include freezing or drying, such as by lyophilization. The viruses can be stored at a concentration of $10^5$-$10^{10}$ pfu/mL, for example, $10^7$-$10^9$ pfu/mL, such as at least or about or $10^6$ pfu/mL, $10^7$ pfu/mL, $10^8$ pfu/mL or $10^9$ pfu/mL. Immediately prior to use in the methods provided herein, the stored viruses are reconstituted (if dried for storage) and diluted in an appropriate medium or solution. The following sections provide exemplary methods that can be used for the production and preparation of viruses for use in any of the methods provided herein.

1. Host Cells for Propagation

The clonal virus strains or recombinant virus strains thereof provided herein can be propagated in an appropriate host cell. Such cells can be a group of a single type of cells or a mixture of different types of cells. Host cells can include cultured cell lines primary cells, and proliferative cells. These host cells can include any of a variety of animal cells, such as mammalian, avian and insect cells and tissues that are susceptible to the virus, such as vaccinia virus, infection, including chicken embryo, rabbit, hamster, and monkey kidney cells. Suitable host cells include, but are not limited to, hematopoietic cells (totipotent, stem cells, leukocytes, lymphocytes, monocytes, macrophages, APC, dendritic cells, non-human cells and the like), pulmonary cells, tracheal cells, hepatic cells, epithelial cells, endothelial cells, muscle cells (e.g., skeletal muscle, cardiac muscle or smooth muscle), fibroblasts, and cell lines including, for example, CV-1, BSC40, Vero, and BSC-1, and human HeLa cells. Typically, viruses are propagated in cell lines that that can be grown at monolayers or in suspension. For example, exemplary cell lines for the propagation of vaccinia viruses include, but are not limited to, CV-1, BSC40, Vero, BGM, BSC-1 and RK-13 cells. Exemplary cell lines for the propagation of adenovirus include, but are not limited to, HeLa, MK, HEK 293 and HDF cells. Exemplary cell lines for the propagation of herpesviruses include, but are not limited to, WI-38 and HeLa cells. Other cell lines suitable for the propagation of a variety of viruses are well known in the art. Purification of the cultured strain from the system can be effected using standard methods.

2. Concentration Determination

The concentration of virus in a solution, or virus titer, can be determined by a variety of methods known in the art. In some methods, a determination of the number of infectious virus particles is made (typically termed plaque forming units (PFU)), while in other methods, a determination of the total number of viral particles, either infectious or not, is made. Methods that calculate the number of infectious virions include, but are not limited to, the plaque assay, in which titrations of the virus are grown on cell monolayers and the number of plaques is counted after several days to several weeks, and the endpoint dilution method, which determines the titer within a certain range, such as one log. Methods that determine the total number of viral particles, including infectious and non-infectious, include, but are not limited to, immunohistochemical staining methods that utilize antibodies that recognize a viral antigen and which can be visualized by microscopy or FACS™ analysis; optical absorbance, such as at 260 nm; and measurement of viral nucleic acid, such as by PCR, RT-PCR, or quantitation by labeling with a fluorescent dye.

3. Storage Methods

Once the virus has been purified (or to a desired purity) and the titer has been determined, the virus can be stored in conditions which optimally maintain its infectious integrity. Typically, viruses are stored in the dark, because light serves to inactivate the viruses over time. Viral stability in storage is usually dependent upon temperatures. Although some viruses are thermostable, most viruses are not stable for more than a day at room temperature, exhibiting reduced viability (Newman et al., (2003) *J. Inf. Dis.* 187:1319-1322). For short-term storage of viruses, for example, 1 day, 2 days, 4 days or 7 days, temperatures of approximately 4° C. are generally recommended. For long-term storage, most viruses can be kept at −20° C., −70° C. or −80° C. When frozen in a simple solution such as PBS or Tris solution (20 mM Tris pH 8.0, 200 NaCl, 2-3% glycerol or sucrose) at these temperatures, the virus can be stable for 6 months to a year, or even longer. Repeated freeze-thaw cycles are generally avoided, however, since it can cause a decrease in viral titer. The virus also can be frozen in media containing other supplements in the storage solution which can further preserve the integrity of the virus. For example, the addition of serum or bovine serum albumin (BSA) to a viral solution stored at −80° C. can help retain virus viability for longer periods of time and through several freeze-thaw cycles. In other examples, the virus sample is dried for long-term storage at ambient temperatures. Viruses can be dried using various techniques including, but not limited to, freeze-drying, foam-drying, spray-drying and desiccation. Other methods for the storage of viruses at ambient, refrigerated or freezing temperatures are known in the art, and include, but are not limited to, those described in U.S. Pat. Nos. 5,149, 653; 6,165,779; 6,255,289; 6,664,099; 6,872,357; and 7,091,030; and in U.S. Pat. Pub. Nos. 2003-0153065, 2004-003841 and 2005-0032044.

Viruses can react differently to each storage method. For example, polio virus is readily degraded at room temperature in aqueous suspension, is stable for only two weeks at 0° C., and is destroyed by lyophilization. For this particular virus methods of storage typically involve freezing at −70° C. or refrigeration at 4° C. In contrast, vaccinia virus is considered very stable, and can be stored in solution at 4° C., frozen at, for example −20° C., −70° C. or −80° C., or lyophilized with little loss of viability (Newman et al., (2003) J. Inf. Dis. 187:1319-1322, Hruby et al., (1990) *Clin. Microb. Rev.* 3:153-170). Methods and conditions suitable for the storage of particular viruses are known in the art, and can be used to store the viruses used in the methods presented herein.

Water is a reactant in nearly all of the destructive pathways that degrade viruses in storage. Further, water acts as a plasticizer, which allows unfolding and aggregation of proteins. Since water is a participant in almost all degradation pathways, reduction of the aqueous solution of viruses to a dry powder provides an alternative formulation methodology to enhance the stability of such samples. Lyophilization, or freeze-drying, is a drying technique used for storing viruses (see, e.g., Cryole et al., (1998) *Pharm. Dev. Technol.*, 3(3), 973-383). There are three stages to freeze-drying; freezing, primary drying and secondary drying. During these stages, the material is rapidly frozen and dehydrated under high vacuum. Once lyophilized, the dried virus can be stored for long periods of time at ambient temperatures, and reconstituted with an aqueous solution when needed. Various stabilizers can be included in the solution prior to freeze-drying to enhance the preservation of the virus. For example, it is known that high molecular weight structural additives, such as serum, serum albumin or gelatin, aid in preventing viral aggregation during freezing, and provide structural and nutritional support in the lyophilized or dried state. Amino acids such as arginine and glutamate, sugars, such as trehalose, and alcohols such as mannitol, sorbitol and inositol, can enhance the preservation of viral infectivity during lyophilization and in the lyophilized state. When added to the viral solution prior to lyophilization, urea and ascorbic acid can stabilize the hydration state and maintain osmotic balance during the dehydration period. Typically, a relatively constant pH of about 7.0 is maintained throughout lyophilization.

4. Preparation of Virus

Immediately prior to use, the virus can be prepared at an appropriate concentration in suitable media, and can be maintained at a cool temperature, such as on ice, until use. If the virus was lyophilized or otherwise dried for storage, then it can be reconstituted in an appropriate aqueous solution. The aqueous solution in which the virus is prepared is typically the medium used in the assay (e.g., DMEM or RPMI) or one that is compatible, such as a buffered saline solution (e.g., PBS, TBS, Hepes solution). For pharmaceutical applications, the virus can be immediately prepared or reconstituted in a pharmaceutical solution. Numerous pharmaceutically acceptable solutions for use are well known in the art (see e.g. Remington's Pharmaceutical Sciences (18$^{th}$ edition) ed. A. Gennaro, 1990, Mack Publishing Co., Easton, Pa.). In one example, the viruses can be diluted in a physiologically acceptable solution, such as sterile saline or sterile buffered saline, with or without an adjuvant or carrier. In other examples, the pharmaceutical solution can contain a component that provides viscosity (e.g. glycerol) and/or component that has bactericidal properties (e.g. phenol). In some examples, the virus is prepared in a relatively concentrated solution so that only a small volume is required in the assay. For example, if $1\times10^6$ pfu of virus is being added to tumor cells in a 96 well plate, then the virus can be prepared at a concentration of $1\times10^8$ pfu/mL so that only 10 µl is added to each well. The particular concentration can be empirically determined by one of skill in the art depending on the particular application.

F. PHARMACEUTICAL COMPOSITIONS, COMBINATIONS AND KITS

Provided herein are pharmaceutical compositions, combinations and kits containing a virus provided herein. Pharmaceutical compositions can include a virus provided herein and a pharmaceutical carrier. Combinations can include, for example, two or more viruses, a virus and a detectable compound, a virus and a therapeutic compound, a virus and a viral expression modulating compound, or any combination thereof. Kits can include one or more pharmaceutical compositions or combinations provided herein, and one or more components, such as instructions for use, a device for administering the pharmaceutical composition or combination to a subject, a device for administering a therapeutic or diagnostic compound to a subject or a device for detecting a virus in a subject.

A virus contained in a pharmaceutical composition, combination or kit can include any virus provided herein, including any isolated clonal virus strain described herein. The pharmaceutical compositions, combinations or kits can include one or more additional viruses that can be selected from a viruses provided herein or other therapeutic or diagnostic virus.

1. Pharmaceutical Compositions

Provided herein are pharmaceutical compositions containing a virus provided herein and a suitable pharmaceutical carrier. A pharmaceutically acceptable carrier includes a solid, semi-solid or liquid material that acts as a vehicle carrier or medium for the virus. Pharmaceutical compositions provided herein can be formulated in various forms, for example in solid, semi-solid, aqueous, liquid, powder or lyophilized form. Exemplary pharmaceutical compositions containing a virus provided herein include, but are not limited to, sterile injectable solutions, sterile packaged powders, eye drops, tablets, pills, powders, lozenges, sachets, cachets, elixirs, suspensions, emulsions, solutions, syrups, aerosols (as a solid or in a liquid medium), ointments, soft and hard gelatin capsules, and suppositories.

Examples of suitable pharmaceutical carriers are known in the art and include, but are not limited to, water, buffers, saline solutions, phosphate buffered saline solutions, various types of wetting agents, sterile solutions, alcohols, gum arabic, vegetable oils, benzyl alcohols, gelatin, glycerin, carbohydrates, such as lactose, sucrose, dextrose, amylose or starch, sorbitol, mannitol, magnesium stearate, talc, silicic acid, viscous paraffin, perfume oil, fatty acid monoglycerides and diglycerides, pentaerythritol fatty acid esters, hydroxy methylcellulose, powders, among others. Pharmaceutical compositions provided herein can contain other additives including, for example, antioxidants, preserving agents, analgesic agents, binders, disintegrants, coloring, diluents, excipients, extenders, glidants, solubilizers, stabilizers, tonicity agents, vehicles, viscosity agents, flavoring agents, sweetening agents, emulsions, such as oil/water emulsions, emulsifying and suspending agents, such as acacia, agar, alginic acid, sodium alginate, bentonite, carbomer, carrageenan, carboxymethylcellulose, cellulose, cholesterol, gelatin, hydroxyethyl cellulose, hydroxypropyl cellulose, hydroxypropyl methylcellulose, methylcellulose, octoxynol 9, oleyl alcohol, povidone, propylene glycol monostearate, sodium lauryl sulfate, sorbitan esters, stearyl alcohol, tragacanth, xanthan gum, and derivatives thereof, solvents, and miscellaneous ingredients, such as, but not limited to, crystalline cellulose, microcrystalline cellulose, citric acid, dextrin, liquid glucose, lactic acid, lactose, magnesium chloride, potassium metaphosphate, starch, among others. Such carriers and/or additives can be formulated by conventional methods and can be administered to the subject at a suitable dose. Stabilizing agents such as lipids, nuclease inhibitors, polymers, and chelating agents can preserve the compositions from degradation within the body. Other suitable formulations for use in a pharmaceutical composition can be found, for example, in *Remington: The Science and Practice of Pharmacy* (2005, Twenty-first edition, Gennaro & Gennaro, eds., Lippencott Williams and Wilkins).

Pharmaceutical formulations that include a virus provided herein for injection or mucosal delivery typically include aqueous solutions of the virus provided in a suitable buffer for injection or mucosal administration or lyophilized forms of the virus for reconstitution in a suitable buffer for injection or mucosal administration. Such formulations optionally can contain one or more pharmaceutically acceptable carriers and/or additives as described herein or known in the art. Liquid compositions for oral administration generally include aqueous solutions, suitably flavored syrups, aqueous or oil suspensions, and flavored emulsions with edible oils such as corn oil, cottonseed oil, sesame oil, coconut oil, or peanut oil, as well as elixirs and similar pharmaceutical vehicles.

Pharmaceutical compositions provided herein can be formulated to provide quick, sustained or delayed released of a virus as described herein by employing procedures known in the art. For preparing solid compositions such as tablets, a virus provided herein is mixed with a pharmaceutical carrier to form a solid composition. Optionally, tablets or pills are coated or otherwise compounded to provide a dosage form affording the advantage of prolonged action in the subject. For example, a tablet or pill comprises an inner dosage and an outer dosage component, the latter being in the form of an envelope over the former. The two components can be separated by an enteric layer, for example, which serves to resist disintegration in the stomach and permit the inner component to pass intact into the duodenum or to be delayed in release. A variety of materials are used for such enteric layers or coatings, including, for example, a number of polymeric acids and mixtures of polymeric acids with such materials as shellac, cetyl alcohol, and cellulose acetate.

Compositions for inhalation or insufflation include solutions and suspensions in pharmaceutically acceptable, aqueous or organic solvents, or mixtures thereof, and powders. These liquid or solid compositions optionally can contain suitable pharmaceutically acceptable excipients and/or additives as described herein or known in the art. Such compositions are administered, for example, by the oral or nasal respiratory route for local or systemic effect. Compositions in pharmaceutically acceptable solvents are nebulized by use of inert gases. Nebulized solutions are inhaled, for example, directly from the nebulizing device, from an attached face mask tent, or from an intermittent positive pressure breathing machine. Solution, suspension, or powder compositions are administered, orally or nasally, for example, from devices which deliver the formulation in an appropriate manner such as, for example, use of an inhaler.

Pharmaceutical compositions provided herein can be formulated for transdermal delivery via a transdermal delivery devices ("patches"). Such transdermal patches are used to provide continuous or discontinuous infusion of a virus provided herein. The construction and use of transdermal patches for the delivery of pharmaceutical agents are performed according to methods known in the art. See, for example, U.S. Pat. No. 5,023,252. Such patches are constructed for continuous, pulsatile, or on-demand delivery of a virus provided herein.

Colloidal dispersion systems that can be used for delivery of viruses include macromolecule complexes, nanocapsules, microspheres, beads and lipid-based systems including oil-in-water emulsions (mixed), micelles, liposomes and lipoplexes. An exemplary colloidal system is a liposome. Organ-specific or cell-specific liposomes can be used in order to achieve delivery only to the desired tissue. The targeting of liposomes can be carried out by the person skilled in the art by applying commonly known methods. This targeting includes passive targeting (utilizing the natural tendency of the liposomes to distribute to cells of the RES in organs which contain sinusoidal capillaries) or active targeting (for example, by coupling the liposome to a specific ligand, for example, an antibody, a receptor, sugar, glycolipid and protein by methods know to those of skill in the art). Monoclonal antibodies can be used to target liposomes to specific tissues, for example, tumor tissue, via specific cell-surface ligands.

2. Host Cells

Host cells that contain a virus provided herein are provided. Such cells can be employed in vitro use or in vivo use, for example, as described in the diagnostic or therapeutic methods provided herein. The host cells can be a group of a single type of cells or a mixture of different types of cells. Host cells can include cultured cell lines, primary cells and proliferative cells. The host cells can include any of a variety of animal cells, such as mammalian, avian and insect cells and tissues that are susceptible to infection by the virus, including, but not limited to, human, primate, rodent (e.g. mouse, rate, hamster, or rabbit) and chicken embryo cells. Suitable host cells include, but are not limited to, hematopoietic cells (totipotent, stem cells, leukocytes, lymphocytes, monocytes, macrophages, APC, dendritic cells, non-human cells and the like), pulmonary cells, tracheal cells, hepatic cells, epithelial cells, endothelial cells, muscle cells (e.g., skeletal muscle, cardiac muscle or smooth muscle), fibroblasts, tumor cells and cell lines including, for example, CV-1, BSC40, Vero, BSC40 and BSC-1, and human HeLa cells. Methods for infecting and/or transforming host cells, phenotypically selecting infected cells or transformants, and other such methods are known in the art.

3. Combinations

Provided are combinations of a virus provided herein and a second agent, such as a second virus or other therapeutic or diagnostic agent. A combination can include a virus provided herein with one or more additional viruses, including, for example, one or more additional diagnostic or therapeutic viruses. A combination can contain pharmaceutical compositions containing a virus provided herein or host cells containing a virus as described herein. A combination also can include any virus or reagent for effecting attenuation thereof in accord with the methods provided herein such as, for example, an antiviral or chemotherapeutic agent. Combinations also can contain a compound used for the modulation of gene expression from endogenous or heterologous genes encoded by the virus.

Combinations provided herein can contain a virus and a therapeutic compound. Therapeutic compounds for the compositions provided herein can be, for example, an anti-cancer or chemotherapeutic compound. Exemplary therapeutic compounds include, for example, cytokines, growth factors, photosensitizing agents, radionuclides, toxins, siRNA molecules, enzyme/prodrug pairs, anti-metabolites, signaling modulators, anti-cancer antibiotics, anti-cancer antibodies, angiogenesis inhibitors, chemotherapeutic compounds, antimetastatic compounds or a combination of any thereof. Viruses provided herein can be combined with an anti-cancer compound, such as a platinum coordination complex. Exemplary platinum coordination complexes include, for example, cisplatin, carboplatin, oxaliplatin, DWA2114R, NK121, IS 3 295, and 254-S. Exemplary chemotherapeutic agents also include, but are not limited to, methotrexate, vincristine, adriamycin, non-sugar containing chloroethylnitrosoureas, 5-fluorouracil, mitomycin C, bleomycin, doxorubicin, dacarbazine, Taxol®, fragyline, Meglumine GLA, valrubicin, carmustine, polifeprosan, MM1270, BAY 12-9566, RAS farnesyl transferase inhibitor, farnesyl transferase inhibitor, MMP, MTA/LY231514, lometrexol/LY264618, Glamolec, CI-994, TNP-470, Hycamtin®/topotecan, PKC412, Valspodar/PSC833, Novantrone®/mitoxantrone, Metaret®/suramin, BB-94/batimastat, E7070, BCH-4556, CS-682, 9-AC, AG3340, AG3433, Incel™/VX-710, VX-853, ZD0101, IS1641, ODN 698, TA 2516/marimastat, BB2516/marimastat, CDP 845, D2163, PD183805, DX8951f, Lemonal DP 2202, FK 317, picibanil/OK-432, valrubicin/AD 32, strontium-89/Metastron®, Temodal®/temozolomide, Yewtaxan/paclitaxel, Taxol®/paclitaxel, Paxex/paclitaxel, Cyclopax/oral paclitaxel, Xeloda®/capecitabine, Furtulon™/doxifluridine, oral taxoids, SPU-077/cisplatin, HMR 1275/flavopiridol, CP-358 (774)/EGFR, CP-609 (754)/RAS oncogene inhibitor, BMS-182751/oral platinum, UFT(Tegafur/Uracil), Ergamisol®/levamisole, Campto®/levamisole, Eniluracil/776C85/5FU enhancer, Camptosar®/irinotecan, Tomudex®/raltitrexed, Leustatin®/cladribine, Caelyx®/liposomal doxorubicin, Myocetliposomal doxorubicin, Doxilliposomal doxorubicin, Evacet™/liposomal doxorubicin, Fludara®/fludarabine, Pharmorubicinepirubicin, DepoCyt®, ZD1839, LU 79553/Bis-Naphthalimide, LU 103793/Dolastain, Gemzar®/gemcitabine, ZD 0473/Anormed, YM 116, Iodine seeds, CDK4 and CDK2 inhibitors, PARP inhibitors, D4809/dexifosfamide, Ifex®/Mesnex®/ifosfamide, Vumon®/teniposide, Paraplatin®/carboplatin, Platinol®/cisplatin, VePesid®/Eposin®/Etopophos®/etoposide, ZD 9331, Taxotere®/docetaxel, prodrugs of guanine arabinoside, taxane analogs, nitrosoureas, alkylating agents such as melphalan and cyclophosphamide, aminoglutethimide, asparaginase, busulfan, carboplatin, chlorambucil, cytarabine HCl, dactinomycin, daunorubicin HCl, estramustine phosphate sodium, etoposide (VP16-213), floxuridine, fluorouracil (5-FU), flutamide, hydroxyurea (hydroxycarbamide), ifosfamide, interferon alfa-2a, interferon alfa-2b, leuprolide acetate (LHRH-releasing factor analogue), lomustine (CCNU), mechlorethamine HCl (nitrogen mustard), mercaptopurine, mesna, mitotane (o,p'-DDD), mitoxantrone HCl, octreotide, plicamycin, procarbazine HCl, streptozocin, tamoxifen citrate, thioguanine, thiotepa, vinblastine sulfate, amsacrine (m-AMSA), azacitidine, erythropoietin, hexamethylmelamine (HMM), interleukin 2, mitoguazone (methyl-GAG; methyl glyoxal bis-guanylhydrazone; MGBG), pentostatin (2'deoxycoformycin), semustine (methyl-CCNU), teniposide (VM-26) and vindesine sulfate. Additional exemplary therapeutic compounds for the use in pharmaceutical compositions and combinations provided herein can be found elsewhere herein (see e.g., Section I for exemplary cytokines, growth factors, photosensitizing agents, radionuclides, toxins, siRNA molecules, enzyme/pro-drug pairs, anti-metabolites, signaling modulators, anti-cancer antibiotics, anti-cancer antibodies, angiogenesis inhibitors, and chemotherapeutic compounds).

In some examples, the combination can include additional therapeutic compounds such as, for example, compounds that are substrates for enzymes encoded and expressed by the virus, or other therapeutic compounds provided herein or known in the art to act in concert with a virus. For example, the virus can express an enzyme that converts a prodrug into an active chemotherapy drug for killing the cancer cell. Hence, combinations provided herein can contain a therapeutic compound, such as a prodrug. An exemplary virus/therapeutic compound combination can include a virus encoding Herpes simplex virus thymidine kinase with the prodrug ganciclovir. Additional exemplary enzyme/pro-drug pairs, for the use in combinations provided include, but are not limited to, varicella zoster thymidine kinase/ganciclovir, cytosine deaminase/5-fluorouracil, purine nucleoside phosphorylase/6-methylpurine deoxyriboside, beta lactamase/cephalosporin-doxorubicin, carboxypeptidase G2/4-[(2-chloroethyl)(2-mesyloxyethyl)amino]benzoyl-L-glutamic acid, cytochrome P450/acetominophen, horseradish peroxidase/indole-3-acetic acid, nitroreductase/C B1954, rabbit carboxylesterase/7-ethyl-10-[4-(1-piperidino)-1-piperidino] carbonyloxycamptothecin (CPT-11), mushroom tyrosinase/bis-(2-chloroethyl)amino-4-hydroxyphenylaminomethanone 28, beta galactosidase/1-chloromethyl-5-hydroxy-1,2-dihydro-3H-benz[e]indole, beta glucuronidase/epirubicin-glucuronide, thymidine phosphorylase/5'-deoxy-5-fluorouridine, deoxycytidine kinase/cytosine arabinoside, beta-lactamase and linamerase/linamarin. Additional exemplary prodrugs, for the use in combinations can also be found elsewhere herein (see e.g., Section I). Any of a variety of known combinations provided herein or otherwise known in the art can be included in the combinations provided herein.

In some examples, the combination can include compounds that can kill or inhibit viral growth or toxicity. Such compounds can be used to alleviate one or more adverse side effects that can result from viral infection (see, e.g. U.S. Patent Pub. No. US 2009-016228-A1). Combinations provided herein can contain antibiotic, antifungal, anti-parasitic or antiviral compounds for treatment of infections. In some examples, the antiviral compound is a chemotherapeutic agent that inhibits viral growth or toxicity. Exemplary antibiotics which can be included in a combination with a virus provided herein include, but are not limited to, ceftazidime, cefepime, imipenem, aminoglycoside, vancomycin and antipseudomonal β-lactam. Exemplary antifungal agents which can be included in a combination with a virus provided herein include, but are not limited to, amphotericin B, dapsone, fluconazole, flucytosine, griseofulvin, itraconazole, ketoconazole, miconazole, clotrimazole, nystatin, and combinations thereof. Exemplary antiviral agents can be included in a combination with a virus provided herein include, but are not limited to, cidofovir, alkoxyalkyl esters of cidofovir (CDV), cyclic CDV, and (S)-9-(3-hydroxy-2 phosphonylmethoxypropyl)adenine, 5-(dimethoxymethyl)-2'-deoxyuridine, isatin-beta-thiosemicarbazone, N-methanocarbathymidine, brivudine, 7-deazaneplanocin A, ST-246, Gleevec®, 2'-beta-fluoro-2',3'-dideoxyadenosine, indinavir, nelfinavir, ritonavir, nevirapine, AZT, ddI, ddC, and combinations thereof. Typically, combinations with an antiviral agent contain an antiviral agent known to be effective against the virus of the combination. For example, combinations can contain a vaccinia virus with an antiviral compound, such as cidofovir, alkoxyalkyl esters of cidofovir, ganciclovir, acyclovir, ST-246, Gleevec®, and derivatives thereof.

In some examples, the combination can include a detectable compound. A detectable compound can include, for example, a ligand, substrate or other compound that can interact with and/or bind specifically to a protein or RNA encoded and expressed by the virus, and can provide a detectable signal, such as a signal detectable by tomographic, spectroscopic, magnetic resonance, or other known techniques. In some examples, the protein or RNA is an exogenous protein or RNA. In some examples, the protein or RNA expressed by the virus modifies the detectable compound where the modified compound emits a detectable signal. Exemplary detectable compounds can be, or can contain, an imaging agent such as a magnetic resonance, ultrasound or tomographic imaging agent, including a radionuclide. The detectable compound can include any of a variety of compounds as provided elsewhere herein or are otherwise known in the art. Exemplary proteins that can be expressed by the virus and a detectable compound combinations employed for detection include, but are not limited to luciferase and luciferin, β-galactosidase and (4,7,10-tri (acetic acid)-1-(2-β-galactopyranosylethoxy)-1,4,7,10-tetraazacyclododecane) gadolinium (Egad), and other combinations known in the art.

In some examples, the combination can include a gene expression modulating compound that regulates expression of one or more genes encoded by the virus. Compounds that modulate gene expression are known in the art, and include, but are not limited to, transcriptional activators, inducers, transcriptional suppressors, RNA polymerase inhibitors and RNA binding compounds such as siRNA or ribozymes. Any of a variety of gene expression modulating compounds known in the art can be included in the combinations provided herein. Typically, the gene expression modulating compound included with a virus in the combinations provided herein will be a compound that can bind, inhibit or react with one or more compounds, active in gene expression such as a transcription factor or RNA of the virus of the combination. An exemplary virus/expression modulator combinations can be a virus encoding a chimeric transcription factor complex having a mutant human progesterone receptor fused to a yeast GAL4 DNA-binding domain an activation domain of the herpes simplex virus protein VP16 and also containing a synthetic promoter containing a series of GAL4 recognition sequences upstream of the adenovirus major late E1B TATA box, where the compound can be RU486 (see, e.g., Yu et al., (2002) *Mol Genet Genomics* 268:169-178). A variety of other virus/expression modulator combinations known in the art also can be included in the combinations provided herein.

In some examples, the combination can contain nanoparticles. Nanoparticles can be designed such that they carry one or more therapeutic agents provided herein. Additionally, nanoparticles can be designed to carry a molecule that targets the nanoparticle to the tumor cells. In one non-limiting example, nanoparticles can be coated with a radionuclide and, optionally, an antibody immunoreactive with a tumor-associated antigen.

In some examples, the combination can contain one or more additional therapeutic and/or diagnostic viruses or other therapeutic and/or diagnostic microorganism (e.g. therapeutic and/or diagnostic bacteria) for diagnosis or treatment. Exemplary therapeutic and/or diagnostic viruses are known in the art and include, but are not limited to, therapeutic and/or diagnostic poxviruses, herpesviruses, adenoviruses, adeno-associated viruses, and reoviruses.

4. Kits

The viruses, cells, pharmaceutical compositions or combinations provided herein can be packaged as kits. Kits can optionally include one or more components such as instructions for use, devices and additional reagents, and components, such as tubes, containers and syringes for practice of the methods. Exemplary kits can include a virus provided herein, and can optionally include instructions for use, a device for detecting a virus in a subject, a device for administering the virus to a subject, or a device for administering an additional agent or compound to a subject.

In one example, a kit can contain instructions. Instructions typically include a tangible expression describing the virus and, optionally, other components included in the kit, and methods for administration, including methods for determining the proper state of the subject, the proper dosage amount, and the proper administration method, for administering the virus. Instructions can also include guidance for monitoring the subject over the duration of the treatment time.

In another example, a kit can contain a device for detecting a virus in a subject. Devices for detecting a virus in a subject can include a low light imaging device for detecting light, for example, emitted from luciferase, or fluoresced from fluorescent protein, such as a green or red fluorescent protein, a magnetic resonance measuring device such as an MRI or NMR device, a tomographic scanner, such as a PET, CT, CAT, SPECT or other related scanner, an ultrasound device, or other device that can be used to detect a protein expressed by the virus within the subject. Typically, the device of the kit will be able to detect one or more proteins expressed by the virus of the kit. Any of a variety of kits containing viruses and detection devices can be included in the kits provided herein, for example, a virus expressing luciferase and a low light imager or a virus expressing fluorescent protein, such as a green or red fluorescent protein, and a low light imager.

Kits provided herein also can include a device for administering a virus to a subject. Any of a variety of devices known in the art for administering medications, pharmaceutical compositions and vaccines can be included in the kits provided herein. Exemplary devices include, but are not limited to, a hypodermic needle, an intravenous needle, a catheter, a needle-less injection device, an inhaler and a liquid dispenser, such as an eyedropper. For example, a virus to be delivered systemically, for example, by intravenous injection, can be included in a kit with a hypodermic needle and syringe. Typically, the device for administering a virus of the kit will be compatible with the virus of the kit; for example, a needle-less injection device such as a high pressure injection device can be included in kits with viruses not damaged by high pressure injection, but is typically not included in kits with viruses damaged by high pressure injection.

Kits provided herein also can include a device for administering an additional agent or compound to a subject. Any of a variety of devices known in the art for administering medications to a subject can be included in the kits provided herein. Exemplary devices include, but are not limited to, a hypodermic needle, an intravenous needle, a catheter, a needle-less injection device, an inhaler and a liquid dispenser, such as an eyedropper. Typically the device for administering the compound of the kit will be compatible with the desired method of administration of the compound. For example, a compound to be delivered systemically or subcutaneously can be included in a kit with a hypodermic needle and syringe.

G. THERAPEUTIC, DIAGNOSTIC AND MONITORING METHODS

The viruses provided herein, including the clonal virus strains provided herein, can be used in diagnostic, monitoring and therapeutic methods. For example, in therapeutic methods the viruses provided herein, including the clonal virus strains, can be used for the treatment of proliferative disorders or conditions, including the treatment of cancerous cells, neoplasms, tumors, metastases and other immunoprivileged cells or tissues, such as wounded or inflamed tissues. The viruses provided herein, including the clonal virus strains provided herein, can be used in diagnostic methods for detecting and imaging of cancerous cells, tumors and metastases monitoring treatment. In other examples, the viruses provided herein, including the clonal virus strains, can be used in diagnostic or monitoring methods to detect virus activity in the host. The diagnostic and therapeutic methods provided herein include, but are not limited to, administering a virus provided herein to a subject containing a tumor and/or metastases. In other examples, the viruses provided herein, including the clonal virus strains provided herein, can be used as vaccines in vaccination methods.

The administered viruses possess one or more characteristics including attenuated pathogenicity, low toxicity, preferential accumulation in tumor, ability to activate an immune response against tumor cells, immunogenicity, replication competence, ability to express additional exogenous diagnostic and/or therapeutic genes, and an ability to elicit antibody production against an expressed gene product. The viruses can be administered for diagnosis, monitoring, such as monitoring therapy, and/or therapy of subjects, such as, but not limited to, humans and other mammals, including, but not limited to, rodents, dogs, cats, primates and livestock. The viruses provided herein can be used or modified for use in any known methods (or uses) in which LIVP viruses have been employed or can be employed. Any LIVP virus, including the GLV-1h68 virus and derivatives thereof, can be used and/or modified for use in the therapeutic and diagnostic methods described below and discussed throughout the disclosure herein.

1. Therapeutic Methods

The viruses provided herein, including the clonal virus strains, for example, can be used for the treatment of proliferative disorders or conditions, including the treatment (such as inhibition) of cancerous cells, neoplasms, tumors, metastases, cancer stem cells, and other immunoprivileged cells or tissues, such as wounded or inflamed tissues. The viruses provided herein preferentially accumulate in tumors or metastases. In some examples, the administration of a virus provided herein results in a slowing of tumor growth. In other examples, the administration of a virus provided herein results in a decrease in tumor volume, including elimination or eradication of the tumor. The therapeutic methods and uses provided herein, however, do not require the administered virus to kill tumor cells or decrease the tumor size. Instead, the methods provided herein include administering to a subject a virus provided herein that can cause or enhance an anti-tumor immune response in the subject. In some examples, the viruses provided herein can be administered to a subject without causing viral-induced disease in the subject. In some examples, the viruses can elicit an anti-tumor immune response in the subject, where typically the viral-mediated anti-tumor immune response can develop, for example, over several days, a week or more, 10 days or more, two weeks or more, or a month or more. In some exemplary methods, the virus can be present in the tumor, and can cause an anti-tumor immune response without the virus itself causing enough tumor cell death to prevent tumor growth. In some examples, the tumor is a monotherapeutic tumor or monotherapeutic cancer, where the tumor or cancer does not decrease in volume when treated with the virus or a therapeutic agent alone.

In some examples, the therapeutic methods provided herein inhibit tumor growth in a subject, where the methods include administering to a subject a virus that can accumulate in a tumor and/or metastasis, and can cause or enhance an anti-tumor immune response. The anti-tumor immune response induced as a result of tumor or metastases-accumulated viruses can result in inhibition of tumor growth.

In some examples, the therapeutic methods provided herein inhibit growth or formation of a metastasis in a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in inhibition of metastasis growth or formation.

In other examples, the therapeutic methods provided herein decrease the size of a tumor and/or metastasis in a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in a decrease in the size of the tumor and/or metastasis.

In some examples, the therapeutic methods provided herein eliminate a tumor and/or metastasis from a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in elimination of the tumor and/or metastasis from the subject.

Methods of reducing or inhibiting tumor growth, inhibiting metastasis growth and/or formation, decreasing the size of a tumor or metastasis, eliminating a tumor or metastasis and/or cancer stem cell or other tumor therapeutic methods provided herein include causing or enhancing an anti-tumor immune response in the host. The immune response of the host, being anti-tumor in nature, can be mounted against tumors and/or metastases in which viruses have accumulated, and can also be mounted against tumors and/or metastases in which viruses have not accumulated, including tumors and/or metastases that form after administration of the virus to the subject. Accordingly, a tumor and/or metastasis whose growth or formation is inhibited, or whose size is decreased, or that is eliminated, can be a tumor and/or metastasis in which the viruses have accumulated, or also can be a tumor and/or metastasis in which the viruses have not accumulated. Accordingly, provided herein are methods of reducing or inhibiting tumor growth, inhibiting metastasis growth and/or formation, decreasing the size of a tumor or metastasis, eliminating a tumor or metastasis, or other tumor therapeutic methods, where the method includes administering to a subject a virus provided herein, where the virus accumulates in at least one tumor or metastasis and causes or enhances an anti-tumor immune response in the subject, and the immune response also is mounted against a tumor and/or metastasis in which the virus cell did not accumulate. In another example, methods are provided for inhibiting or preventing recurrence of a neoplastic disease or inhibiting or preventing new tumor growth, where the methods include administering to a subject a virus provided herein that can accumulate in a tumor and/or metastasis, and can cause or enhance an anti-tumor immune response, and the anti-tumor immune response can inhibit or prevent recurrence of a neoplastic disease or inhibit or prevent new tumor growth.

The tumor or neoplastic disease therapeutic methods provided herein, such as methods of reducing or inhibiting tumor growth, inhibiting metastasis growth and/or formation, decreasing the size of a tumor or metastasis, eliminating a tumor or metastasis, or other tumor therapeutic methods, also can include administering to a subject a virus provided herein that can cause tumor cell lysis or tumor cell death. Such a virus can be the same virus as the virus that can cause or enhance an anti-tumor immune response in the subject. Viruses, such as the viruses provided herein, can cause cell lysis or tumor cell death as a result of expression of an endogenous gene or as a result of an exogenous gene. Endogenous or exogenous genes can cause tumor cell lysis or inhibit cell growth as a result of direct or indirect actions, as is known in the art, including lytic channel formation or activation of an apoptotic pathway. Gene products, such as exogenous gene products can function to activate a prodrug to an active, cytotoxic form, resulting in cell death where such genes are expressed.

Such methods of tumor and/or metastasis treatment can include administration of a virus provided herein for therapy, such as for gene therapy, for cancer gene therapy, or for vaccine therapy. Such a virus can be used to stimulate humoral and/or cellular immune response, induce strong cytotoxic T lymphocytes responses in subjects who can benefit from such responses. For example, the virus can provide prophylactic and therapeutic effects against a tumor infected by the virus or other infectious diseases, by rejection of cells from tumors or lesions using viruses that express immunoreactive antigens (Earl et al., *Science* 234: 728-831 (1986); Lathe et al., *Nature* (London) 32: 878-880 (1987)), cellular tumor-associated antigens (Bernards et al., *Proc. Natl. Acad. Sci. USA* 84: 6854-6858 (1987); Estin et al., *Proc. Natl. Acad. Sci. USA* 85: 1052-1056 (1988); Kantor et al., *J. Natl. Cancer Inst.* 84: 1084-1091 (1992); Roth et al., *Proc. Natl. Acad. Sci. USA* 93: 4781-4786 (1996)) and/or cytokines (e.g., IL-2, IL-12), costimulatory molecules (B7-1, B7-2) (Rao et al., *J. Immunol.* 156: 3357-3365 (1996); Chamberlain et al., *Cancer Res.* 56: 2832-2836 (1996); Oertli et al., *J. Gen. Virol.* 77: 3121-3125 (1996); Qin and Chatterjee, *Human Gene Ther.* 7: 1853-1860 (1996); McAneny et al., *Ann. Surg. Oncol.* 3: 495-500 (1996)), or other therapeutic proteins.

As shown previously, solid tumors can be treated with viruses, such as vaccinia viruses, resulting in an enormous tumor-specific virus replication, which can lead to tumor protein antigen and viral protein production in the tumors (U.S. Patent Publication No. 2005-0031643, now U.S. Pat. Nos. 7,588,767, 7,588,771, 7,662,398), which provide and exemplify the GLV-1h68 virus and derivatives thereof. Vaccinia virus administration to mice resulted in lysis of the infected tumor cells and a resultant release of tumor-cell-specific antigens. Continuous leakage of these antigens into the body led to a very high level of antibody titer (in approximately 7-14 days) against tumor proteins, viral proteins, and the virus encoded engineered proteins in the mice. The newly synthesized anti-tumor antibodies and the enhanced macrophage, neutrophils count were continuously delivered via the vasculature to the tumor and thereby provided for the recruitment of an activated immune system against the tumor. The activated immune system then eliminated the foreign compounds of the tumor including the viral particles. This interconnected release of foreign antigens boosted antibody production and continuous response of the antibodies against the tumor proteins to function like an autoimmunizing vaccination system initiated by vaccinia viral infection and replication, followed by cell lysis, protein leakage and enhanced antibody production. Thus, the viruses provided herein and the viruses generated using the methods provided herein can be administered in a complete process that can be applied to all tumor systems with immunoprivileged tumor sites as site of privileged viral growth, which can lead to tumor elimination by the host's own immune system.

In one example, the tumor treated is a cancer such as pancreatic cancer, non-small cell lung cancer, multiple myeloma or leukemia, although the cancer is not limited in this respect, and other metastatic diseases can be treated by the combinations provided herein. For example, the tumor treated can be a solid tumor, such as of the lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS. Exemplary tumors include, for example, pancreatic tumors, ovarian tumors, lung tumors, colon tumors, prostate tumors, cervical tumors and breast tumors. In one example, the tumor is a carcinoma such as, for example, an ovarian tumor or a pancreatic tumor.

In other examples, methods are provided for immunizing a subject, where the methods include administering to the subject a virus that expresses one or more antigens against which antigens the subject will develop an immune response. The immunizing antigens can be endogenous to the virus, such as vaccinia antigens on a vaccinia virus used to immunize against smallpox, measles, mumps, or the immunizing antigens can be exogenous antigens expressed by the virus, such as influenza or HIV antigens expressed on a viral capsid surface. In the case of smallpox, for example, a tumor specific protein antigen can be carried by an attenuated vaccinia virus (encoded by the viral genome) for a smallpox vaccine. Thus, the viruses provided herein, including the modified vaccinia viruses can be used as vaccines.

In some examples, provided herein are methods for eliciting or enhancing antibody production against a selected antigen or a selected antigen type in a subject, where the methods include administering to a subject a virus that can accumulate in a tumor and/or metastasis, and can cause release of a selected antigen or selected antigen type from the tumor, resulting in antibody production against the selected antigen or selected antigen type. Any of a variety of antigens can be targeted in the methods provided herein, including a selected antigen such as an exogenous gene product expressed by the virus, or a selected antigen type such as one or more tumor antigens release from the tumor as a result of viral infection of the tumor (e.g., by lysis, apoptosis, secretion or other mechanism of causing antigen release from the tumor).

In some examples, it can be desirable to maintain release of the selected antigen or selected antigen type over a series of days, for example, at least a week, at least ten days, at least two weeks or at least a month. Provided herein are methods for providing a sustained antigen release within a subject, where the methods include administering to a subject a virus that can accumulate in a tumor and/or metastasis, and can cause sustained release of an antigen, resulting in antibody production against the antigen. The sustained release of antigen can result in an immune response by the viral-infected host, in which the host can develop antibodies against the antigen, and/or the host can mount an immune response against cells expressing the antigen, including an immune response against tumor cells. Thus, the sustained release of antigen can result in immunization against tumor cells. In some examples, the viral-mediated sustained antigen release-induced immune response against tumor cells can result in complete removal or killing of all tumor cells.

2. Diagnostic and Monitoring Methods

The viruses provided herein, including the clonal virus strains provided herein, can be used in diagnostic methods for detecting and imaging of cancerous cells, tumors, cancer stem cells and metastases monitoring treatment. As discussed above, the viruses provided herein can accumulate in tumors or metastases. Hence, methods are provided herein for detecting a tumor or metastasis in a subject by administering a virus strain that encodes a detectable protein or a protein that induces a detectable signal, whereby detecting the detectable protein or protein that induces a detectable signal indicates the presence of the tumor or metastasis. The detectable protein or protein that induces a detectable signaling can be detecting by any imaging technique known to one of skill in the art.

In other examples, the viruses provided herein, including the clonal virus strains, can be used in diagnostic or monitoring methods. For example, the viruses provided herein can be used in methods to detect virus activity in the host, such as replication activity. The viruses provided herein are oncolytic viruses, and hence kill and lyse tumor cells. Active viruses that infect and replicate inside of a tumor cell express protein (e.g. endogenous or transgene-encoded), which upon lysis of the tumor cell can leach out of the tumor cell and circulate in the body. Hence, virus-encoded proteins can be detected in the tumor or in other body fluids as a measure of the activity, such as replication activity, which is a measure of oncolytic activity of the virus. Further, the method also permits direct diagnosis of tumors and confirms successful tumor colonization in tumor bearing patients, since the active virus accumulates and replicates preferentially in tumor cells. Pharmacokinetic assays can be used to measure the detectable protein or protein that induces a detectable signal to monitor infection and/or activity of the virus over time. For example, virus-expressed protein or detectable protein can be detected from a tumor or body fluid after administration of the virus and monitored after minutes, hours, or days following treatment with virus. For example, samples can be taken from the subject and assessed for the virus-expressed protein or detectable protein or the subject can be subjected to imaging for the presence of the detectable protein within 5 minutes, 10 minutes, 20 minutes, 30 minutes, 1 hour, 2 hour, 3 hour, 4 hour, 5 hour, 6 hour, 7 hour, 8 hour, 9 hour, 10 hour, 11 hour, 12 hour, 24 hour or more following administration of virus. In other examples, virus-expressed protein or detectable protein can be assayed every 1 day, 2 day, 3 day, 4 day, 5 days, 6 days or 7 days. In the method of detecting virus activity, detection can be by invasive methods, such as obtaining body fluids from a subject, or by noninvasive methods such as imaging.

In the methods of diagnosis, detection or monitoring, the detectable protein or detectable signal can be any protein encoded by a gene as provided herein above in Section D for which the virus has been modified to express. For example, the detectable protein or protein that induces a detectable signal includes, but is not limited to, a luciferase, a fluorescent protein, a bioluminescent protein, a receptor or transporter protein that binds to and/or transports a contrast agent, chromophore, compound or ligand that can be detected, or melanin encoded by a gene for melanin synthesis. In some examples, the detectable protein or protein that induces a detectable signal is a green fluorescent protein (GFP), red fluorescent protein (RFP), an iron receptor, an iron transporter, an iron transporter, human epinephrine receptor (hNET) and a sodium iodide symporter (NIS) protein.

In any of these examples, the detectable protein or detectable signal can be detected by a method of imaging. Exemplary methods of imaging include, for example, low-light imaging, fluorescence spectroscopy, x-ray imaging, magnetic resonance imaging (MRI), magnetic resonance spectroscopy (MRS), positron emission tomography (PET), single-photon emission computed tomography (SPECT) or (multispectral)photo-/optoacoustic tomography ((MS) OAT). It is within the level of one of skill in the art to choose an appropriate imaging technique depending on the particular detectable protein or detectable signal that is being detected.

In examples of detecting virus activity by invasive methods, such as from collected body fluids of a subject or patient, any body fluid can be collected and assayed for the presence or level of a detectable protein or protein that induces a detectable signal. Non-limiting examples of body fluids include, but are not limited to, urine, blood, tears or cerebrospinal (CSF) fluid. Any method of fluorescence or luminescence detection method can be used, for example, using a fluorescence spectrometer or microscopy; a fluorescence-luminiscence microplate reader; or fluorescence activated cell sorting. In one example of this method for detecting active virus or viral tumor colonization, a probe that can be activated by beta-glucoronidase can be added to a body fluid sample, such as serum, from subjects previously administered with GusA-encoding virus. Exemplary of such probes are GusA-activatable compounds such as FDGlcU and 4-MUG. The body fluid can be a sample that is collected after a certain time after infection of the subject with virus. The sample can be analyzed for activated fluorescent compound.

3. Administration

A virus provided herein can be administered to a subject, including a subject having a tumor or having neoplastic cells, or a subject to be immunized. An administered virus can be a virus provided herein or any other virus generated using the methods provided herein. In some examples, the virus administered is a virus containing a characteristic such as attenuated pathogenicity, low toxicity, preferential accumulation in tumor, ability to activate an immune response against tumor cells, high immunogenicity, replication competence and ability to express exogenous proteins, and combinations thereof.

a. Steps Prior to Administering the Virus

In some examples, one or more steps can be performed prior to administration of the virus to the subject. Any of a variety of preceding steps can be performed, including, but not limited to diagnosing the subject with a condition appropriate for virus administration, determining the immunocompetence of the subject, immunizing the subject, treating the subject with a chemotherapeutic agent, treating the subject with radiation, or surgically treating the subject.

For examples that include administering a virus to a tumor-bearing subject for therapeutic purposes, the subject has typically been previously diagnosed with a neoplastic condition. Diagnostic methods also can include determining the type of neoplastic condition, determining the stage of the neoplastic conditions, determining the size of one or more tumors in the subject, determining the presence or absence of metastatic or neoplastic cells in the lymph nodes of the subject, or determining the presence of metastases of the subject. Some examples of therapeutic methods for administering a virus to a subject can include a step of determination of the size of the primary tumor or the stage of the neoplastic disease, and if the size of the primary tumor is equal to or above a threshold volume, or if the stage of the neoplastic disease is at or above a threshold stage, a virus is administered to the subject. In a similar example, if the size of the primary tumor is below a threshold volume, or if the stage of the neoplastic disease is at or below a threshold stage, the virus is not yet administered to the subject; such methods can include monitoring the subject until the tumor size or neoplastic disease stage reaches a threshold amount, and then administering the virus to the subject. Threshold sizes can vary according to several factors, including rate of growth of the tumor, ability of the virus to infect a tumor, and immunocompetence of the subject. Generally the threshold size will be a size sufficient for a virus to accumulate and replicate in or near the tumor without being completely removed by the host's immune system, and will typically also be a size sufficient to sustain a virus infection for a time long enough for the host to mount an immune response against the tumor cells, typically about one week or more, about ten days or more, or about two weeks or more. Exemplary threshold tumor sizes for viruses, such as vaccinia viruses, are at least about 100 mm$^3$, at least about 200 mm$^3$, at least about 300 mm$^3$, at least about 400 mm$^3$, at least about 500 mm$^3$, at least about 750 mm$^3$, at least about 1000 mm$^3$, or at least about 1500 mm$^3$. Threshold neoplastic disease stages also can vary according to several factors, including specific requirement for staging a particular neoplastic disease, aggressiveness of growth of the neoplastic disease, ability of the virus to infect a tumor or metastasis, and immunocompetence of the subject. Generally the threshold stage will be a stage sufficient for a virus to accumulate and replicate in a tumor or metastasis without being completely removed by the host's immune system, and will typically also be a size sufficient to sustain a virus infection for a time long enough for the host to mount an immune response against the neoplastic cells, typically about one week or more, about ten days or more, or about two weeks or more. Exemplary threshold stages are any stage beyond the lowest stage (e.g., Stage I or equivalent), or any stage where the primary tumor is larger than a threshold size, or any stage where metastatic cells are detected.

In other examples, prior to administering to the subject a virus, the immunocompetence of the subject can be determined. The methods of administering a virus to a subject provided herein can include causing or enhancing an immune response in a subject. Accordingly, prior to administering a virus to a subject, the ability of a subject to mount an immune response can be determined. Any of a variety of tests of immunocompetence known in the art can be performed in the methods provided herein. Exemplary immunocompetence tests can examine ABO hemagglutination titers (IgM), leukocyte adhesion deficiency (LAD), granulocyte function (NBT), T and B cell quantitation, tetanus antibody titers, salivary IgA, skin test, tonsil test, complement C3 levels, and factor B levels, and lymphocyte count. One skilled in the art can determine the desirability to administer a virus to a subject according to the level of immunocompetence of the subject, according to the immunogenicity of the virus, and, optionally, according to the immunogenicity of the neoplastic disease to be treated. Typically, a subject can be considered immunocompetent if the skilled artisan can determine that the subject is sufficiently competent to mount an immune response against the virus.

In some examples, the subject can be immunized prior to administering to the subject a virus according to the methods provided herein. Immunization can serve to increase the ability of a subject to mount an immune response against the virus, or increase the speed at which the subject can mount an immune response against a virus. Immunization also can serve to decrease the risk to the subject of pathogenicity of the virus. In some examples, the immunization can be performed with an immunization virus that is similar to the therapeutic virus to be administered. For example, the immunization virus can be a replication-incompetent variant of the therapeutic virus. In other examples, the immunization material can be digests of the therapeutic virus to be administered. Any of a variety of methods for immunizing a subject against a known virus are known in the art and can be used herein. In one example, vaccinia viruses treated with, for example, 1 microgram of psoralen and ultraviolet light at 365 nm for 4 minutes, can be rendered replication incompetent. In another example, the virus can be selected as the same or similar to a virus against which the subject has been previously immunized, e.g., in a childhood vaccination.

In another example, the subject can have administered thereto a virus without any previous steps of cancer treatment such as chemotherapy, radiation therapy or surgical removal of a tumor and/or metastases. The methods provided herein take advantage of the ability of the viruses to enter or localize near a tumor, where the tumor cells can be protected from the subject's immune system; the viruses can then proliferate in such an immunoprotected region and can also cause the release, typically a sustained release, of tumor antigens from the tumor to a location in which the subject's immune system can recognize the tumor antigens and mount an immune response. In such methods, existence of a tumor of sufficient size or sufficiently developed immunoprotected state can be advantageous for successful administration of the virus to the tumor, and for sufficient tumor antigen production. If a tumor is surgically removed, the viruses may not be able to localize to other neoplastic cells (e.g., small metastases) because such cells have not yet have matured sufficiently to create an immunoprotective environment in which the viruses can survive and proliferate, or even if the viruses can localize to neoplastic cells, the number of cells or size of the mass can be too small for the viruses to cause a sustained release of tumor antigens in order for the host to mount an anti-tumor immune response. Thus, for example, provided herein are methods of treating a tumor or neoplastic disease in which viruses are administered to a subject with a tumor or neoplastic disease without removing the primary tumor, or to a subject with a tumor or neoplastic disease in which at least some tumors or neoplastic cells are intentionally permitted to remain in the subject. In other typical cancer treatment methods such as chemotherapy or radiation therapy, such methods typically have a side effect of weakening the subject's immune system. This treatment of a subject by chemotherapy or radiation therapy can reduce the subject's ability to mount an anti-tumor immune response. Thus, for example, provided herein are methods of treating a tumor or neoplastic disease in which viruses are administered to a subject with a tumor or neoplastic disease without treating the subject with an immune system-weakening therapy, such as chemotherapy or radiation therapy.

In an alternative example, prior to administration of a virus to the subject, the subject can be treated in one or more cancer treatment steps that do not remove the primary tumor or that do not weaken the immune system of the subject. A variety of more sophisticated cancer treatment methods are being developed in which the tumor can be treated without surgical removal or immune-system weakening therapy. Exemplary methods include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound. Thus, combined methods that include administering a virus to a subject can further improve cancer therapy. Thus, provided herein are methods of administering a virus to a subject, along with prior to or subsequent to, for example, administering a compound that slows tumor growth without weakening the subject's immune system or a compound that inhibits vascularization of the tumor.

b. Mode of Administration

Any mode of administration of a virus to a subject can be used, provided the mode of administration permits the virus to enter a tumor or metastasis. Modes of administration can include, but are not limited to, systemic, parenteral, intravenous, intraperitoneal, subcutaneous, intramuscular, transdermal, intradermal, intra-arterial (e.g., hepatic artery infusion), intravesicular perfusion, intrapleural, intraarticular, topical, intratumoral, intralesional, endoscopic, multipuncture (e.g., as used with smallpox vaccines), inhalation, percutaneous, subcutaneous, intranasal, intratracheal, oral, intracavity (e.g., administering to the bladder via a catheter, administering to the gut by suppository or enema), vaginal, rectal, intracranial, intraprostatic, intravitreal, aural, or ocular administration. In some examples, a diagnostic or therapeutic agent as described elsewhere herein also can be similarly administered.

One skilled in the art can select any mode of administration compatible with the subject and the virus, and that also is likely to result in the virus reaching tumors and/or metastases. The route of administration can be selected by one skilled in the art according to any of a variety of factors, including the nature of the disease, the kind of tumor, and the particular virus contained in the pharmaceutical composition. Administration to the target site can be performed, for example, by ballistic delivery, as a colloidal dispersion system, or systemic administration can be performed by injection into an artery.

c. Dosages and Dosage Regime

The dosage regimen can be any of a variety of methods and amounts, and can be determined by one skilled in the art according to known clinical factors. As is known in the medical arts, dosages for any one patient can depend on many factors, including the subject's species, size, body surface area, age, sex, immunocompetence, and general health, the particular virus to be administered, duration and route of administration, the kind and stage of the disease, for example, tumor size, and other treatments or compounds, such as chemotherapeutic drugs, being administered concurrently. In addition to the above factors, such levels can be affected by the infectivity of the virus, and the nature of the virus, as can be determined by one skilled in the art.

In the present methods, appropriate minimum dosage levels and dosage regimes of viruses can be levels sufficient for the virus to survive, grow and replicate in a tumor or metastasis. Generally, the virus is administered in an amount that is at least or about or $1\times10^5$ pfu at least one time over a cycle of administration. Exemplary minimum levels for administering a virus to a 65 kg human can include at least about $1\times10^5$ plaque forming units (pfu), at least about $5\times10^5$ pfu, at least about $1\times10^6$ pfu, at least about $5\times10^6$ pfu, at least about $1\times10^7$ pfu, at least about $1\times10^8$ pfu, at least about $1\times10^9$ pfu, or at least about $1\times10^{10}$ pfu. For example, the virus is administered in an amount that is at least or about or is $1\times10^5$ pfu, $1\times10^6$ pfu, $1\times10^7$ pfu, $1\times10^8$ pfu, $1\times10^9$ pfu, $1\times10^{10}$ pfu, $1\times10^{11}$ pfu, $1\times10^{12}$ pfu, $1\times10^{13}$ pfu, or $1\times10^{14}$ pfu at least one time over a cycle of administration.

In the dosage regime, the amount of virus can be administered as a single administration or multiple times over the cycle of administration. Hence, the methods provided herein can include a single administration of a virus to a subject or multiple administrations of a virus to a subject. In some examples, a single administration is sufficient to establish a virus in a tumor, where the virus can proliferate and can cause or enhance an anti-tumor response in the subject; such methods do not require additional administrations of a virus in order to cause or enhance an anti-tumor response in a subject, which can result, for example in inhibition of tumor growth, inhibition of metastasis growth or formation, reduction in tumor or size, elimination of a tumor or metastasis, inhibition or prevention of recurrence of a neoplastic disease or new tumor formation, or other cancer therapeutic effects.

In other examples, a virus can be administered on different occasions, separated in time typically by at least one day. For example, a virus can be administered two times, three time, four times, five times, or six times or more, with one day or more, two days or more, one week or more, or one month or more time between administrations. Separate administrations can increase the likelihood of delivering a virus to a tumor or metastasis, where a previous administration has been ineffective in delivering a virus to a tumor or metastasis. Separate administrations can increase the locations on a tumor or metastasis where virus proliferation can occur or can otherwise increase the titer of virus accumulated in the tumor, which can increase the scale of release of antigens or other compounds from the tumor in eliciting or enhancing a host's anti-tumor immune response, and also can, optionally, increase the level of virus-based tumor lysis or tumor cell death. Separate administrations of a virus can further extend a subject's immune response against viral antigens, which can extend the host's immune response to tumors or metastases in which viruses have accumulated, and can increase the likelihood of a host mounting an anti-tumor immune response.

When separate administrations are performed, each administration can be a dosage amount that is the same or different relative to other administration dosage amounts. In one example, all administration dosage amounts are the same. In other examples, a first dosage amount can be a larger dosage amount than one or more subsequent dosage amounts, for example, at least 10× larger, at least 100× larger, or at least 1000× larger than subsequent dosage amounts. In one example of a method of separate administrations in which the first dosage amount is greater than one or more subsequent dosage amounts, all subsequent dosage amounts can be the same, smaller amount relative to the first administration.

Separate administrations can include any number of two or more administrations, including two, three, four, five or six administrations. One skilled in the art can readily determine the number of administrations to perform or the desirability of performing one or more additional administrations according to methods known in the art for monitoring therapeutic methods and other monitoring methods provided herein. Accordingly, the methods provided herein include methods of providing to the subject one or more administrations of a virus, where the number of administrations can be determined by monitoring the subject, and, based on the results of the monitoring, determining whether or not to provide one or more additional administrations. Deciding on whether or not to provide one or more additional administrations can be based on a variety of monitoring results, including, but not limited to, indication of tumor growth or inhibition of tumor growth, appearance of new metastases or inhibition of metastasis, the subject's anti-virus antibody titer, the subject's anti-tumor antibody titer, the overall health of the subject, the weight of the subject, the presence of virus solely in tumor and/or metastases, the presence of virus in normal tissues or organs.

The time period between administrations can be any of a variety of time periods. The time period between administrations can be a function of any of a variety of factors, including monitoring steps, as described in relation to the number of administrations, the time period for a subject to mount an immune response, the time period for a subject to clear the virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

For example, an amount of virus is administered two times, three times, four times, five times, six times or seven times over a cycle of administration. The amount of virus can be administered on the first day of the cycle, the first and second day of the cycle, each of the first three consecutive days of the cycle, each of the first four consecutive days of the cycle, each of the first five consecutive days of the cycle, each of the first six consecutive days of the cycle, or each of the first seven consecutive days of the cycle. Generally, the cycle of administration is 7 days, 14 days, 21 days or 28 days. Depending on the responsiveness or prognosis of the patient the cycle of administration is repeated over the course of several months or years.

Generally, appropriate maximum dosage levels or dosage regimes of viruses are levels that are not toxic to the host, levels that do not cause splenomegaly of 3 times or more, levels that do not result in colonies or plaques in normal tissues or organs after about 1 day or after about 3 days or after about 7 days.

d. Co-Administrations

Also provided are methods in which an additional therapeutic substance, such as a different therapeutic virus or a therapeutic compound is administered. These can be administered simultaneously, sequentially or intermittently with the first virus. The additional therapeutic substance can interact with the virus or a gene product thereof, or the additional therapeutic substance can act independently of the virus.

Combination therapy treatment has advantages in that: 1) it avoids single agent resistance; 2) in a heterogeneous tumor population, it can kill cells by different mechanisms; and 3) by selecting drugs with non-overlapping toxicities, each agent can be used at full dose to elicit maximal efficacy and synergistic effect. Combination therapy can be done by combining a diagnostic/therapeutic virus with one or more of the following anti-cancer agents: chemotherapeutic agents, therapeutic antibodies, siRNAs, toxins, enzyme-prodrug pairs or radiation.

i. Administering a Plurality of Viruses

Methods are provided for administering to a subject two or more viruses. Administration can be effected simultaneously, sequentially or intermittently. The plurality of viruses can be administered as a single composition or as two or more compositions. The two or more viruses can include at least two viruses. In a particular example, where there are two viruses, both viruses are vaccinia viruses. In another example, one virus is a vaccinia virus and the second virus is any one of an adenovirus, an adeno-associated virus, a retrovirus, a herpes simplex virus, a reovirus, a mumps virus, a foamy virus, an influenza virus, a myxoma virus, a vesicular stomatitis virus, or any other virus described herein or known in the art. Viruses can be chosen based on the pathway on which they act. For example, a virus that targets an activated Ras pathway can be combined with a virus that targets tumor cells defective in p53 expression.

The plurality of viruses can be provided as combinations of compositions containing and/or as kits that include the viruses packaged for administration and optionally including instructions therefore. The compositions can contain the viruses formulated for single dosage administration (i.e., for direct administration) and can require dilution or other additions.

In one example, at least one of the viruses is a modified virus such as those provided herein, having a characteristic such as low pathogenicity, low toxicity, preferential accumulation in tumor, ability to activate an immune response against tumor cells, immunogenic, replication competent, ability to express exogenous proteins, and combinations thereof. The viruses can be administered at approximately the same time, or can be administered at different times. The viruses can be administered in the same composition or in the same administration method, or can be administered in separate composition or by different administration methods.

The time period between administrations can be any time period that achieves the desired effects, as can be determined by one skilled in the art. Selection of a time period between administrations of different viruses can be determined according to parameters similar to those for selecting the time period between administrations of the same virus, including results from monitoring steps, the time period for a subject to mount an immune response, the time period for a subject to clear virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

ii. Therapeutic Compounds

Any therapeutic or anti-cancer agent can be used as the second, therapeutic or anti-cancer agent in the combined cancer treatment methods provided herein. The methods can include administering one or more therapeutic compounds to the subject in addition to administering a virus or plurality thereof to a subject. Therapeutic compounds can act independently, or in conjunction with the virus, for tumor therapeutic effects.

Therapeutic compounds that can act independently include any of a variety of known chemotherapeutic compounds that can inhibit tumor growth, inhibit metastasis growth and/or formation, decrease the size of a tumor or metastasis, eliminate a tumor or metastasis, without reducing the ability of a virus to accumulate in a tumor, replicate in the tumor, and cause or enhance an anti-tumor immune response in the subject.

Therapeutic compounds that act in conjunction with the viruses include, for example, compounds that alter the expression of the viruses or compounds that can interact with a virally-expressed gene, or compounds that can inhibit virus proliferation, including compounds toxic to the virus. Therapeutic compounds that can act in conjunction with the virus include, for example, therapeutic compounds that increase the proliferation, toxicity, tumor cell killing or immune response eliciting properties of a virus, and also can include, for example, therapeutic compounds that decrease the proliferation, toxicity or cell killing properties of a virus. Optionally, the therapeutic agent can exhibit or manifest additional properties, such as, properties that permit its use as an imaging agent, as described elsewhere herein.

Therapeutic compounds also include, but are not limited to, chemotherapeutic agents, nanoparticles, radiation therapy, siRNA molecules, enzyme/pro-drug pairs, photosensitizing agents, toxins, microwaves, a radionuclide, an angiogenesis inhibitor, a mitosis inhibitor protein (e.g., cdc6), an antitumor oligopeptide (e.g., antimitotic oligopeptides, high affinity tumor-selective binding peptides), a signaling modulator, anti-cancer antibiotics, or a combination thereof.

Exemplary photosensitizing agents include, but are not limited to, for example, indocyanine green, toluidine blue, aminolevulinic acid, texaphyrins, benzoporphyrins, phenothiazines, phthalocyanines, porphyrins such as sodium porfimer, chlorins such as tetra(m-hydroxyphenyl)chlorin or tin(IV) chlorin e6, purpurins such as tin ethyl etiopurpurin, purpurinimides, bacteriochlorins, pheophorbides, pyropheophorbides or cationic dyes. In one example, a vaccinia virus, such as a vaccinia virus provided herein, is administered to a subject having a tumor, cancer or metastasis in combination with a photosensitizing agent.

Radionuclides, which depending up the radionuclide, amount and application can be used for diagnosis and/or for treatment. They include, but are not limited to, for example, a compound or molecule containing $^{32}$Phosphorus, $^{60}$Cobalt, $^{90}$Yttrium, $^{99}$Technitium, $^{103}$Palladium, $^{106}$Ruthenium, $^{111}$Indium, $^{117}$Lutetium, $^{125}$Iodine, $^{131}$Iodine, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth or $^{213}$Bismuth. In one example, a vaccinia virus, such as a vaccinia virus provided herein, is administered to a subject having a tumor, cancer or metastasis in combination with a radionuclide.

Toxins include, but are not limited to, chemotherapeutic compounds such as, but not limited to, 5-fluorouridine, calicheamicin and maytansine. Signaling modulators include, but are not limited to, for example, inhibitors of macrophage inhibitory factor, toll-like receptor agonists and stat3 inhibitors. In one example, a vaccinia virus, such as a vaccinia virus provided herein, is administered to a subject having a tumor, cancer or metastasis in combination with a toxin or a signaling modulator.

Combination therapy between chemotherapeutic agents and therapeutic viruses can be effective/curative in situations when single agent treatment is not effective. Chemotherapeutic compounds include, but are not limited to, alkylating agents such as thiotepa and cyclophosphamide; alkyl sulfonates such as busulfan, improsulfan and piposulfan; aziridines such as benzodepa, carboquone, meturedepa and uredepa; ethylenimine and methylmelamines, including altretamine, triethylenemelamine, triethylenephosphoramide, triethylenethiophosphoramide and trimethylmelamine nitrogen mustards such as chlorambucil, chlornaphazine, chlorophosphamide, estramustine, ifosfamide, mechlorethamine, mechlorethamine oxide hydrochloride, melphalan, novobiocin, phenesterine, prednimustine, trofosfamide, uracil mustard; nitrosoureas such as carmustine, chlorozotocin, fotemustine, lomustine, nimustine, ranimustine; antibiotics such as aclacinomycins, actinomycin, anthramycin, azaserine, bleomycins, cactinomycin, calicheamicin, carubicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as folinic acid; aceglatone; aldophosphamide glycoside; aminolevulinic acid; amsacrine; bestrabucil; bisantrene; edatrexate; defosfamide; demecolcine; diaziquone; eflornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; polysaccharide-K; razoxane; sizofiran; spirogermanium; tenuazonic acid; triaziquone; 2, 2',2"-trichlorotriethylamine; urethan; vindesine; dacarbazine; mannomustine; mitobronitol; mitolactol; pipobroman; gacytosine; cytosine arabinoside; cyclophosphamide; thiotepa; taxoids, e.g., paclitaxel and docetaxel; chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; Navelbine®; Novantrone®; teniposide; daunomycin; aminopterin; Xeloda®; ibandronate; CPT11; topoisomerase inhibitor RFS 2000; difluoromethylornithine (DMFO); retinoic acid; esperamycins; capecitabine; and pharmaceutically acceptable salts, acids or derivatives of any of the above. Also included are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone and toremifene (Fareston®); and antiandrogens such as flutamide, nilutamide, bicalutamide, leuprolide and goserelin; and pharmaceutically acceptable salts, acids or derivatives of any of the above. Such chemotherapeutic compounds that can be used herein include compounds whose toxicities preclude use of the compound in general systemic chemotherapeutic methods. Chemotherapeutic agents also include new classes of targeted chemotherapeutic agents such as, for example, imatinib (sold by Novartis under the trade name Gleevec® in the United States), gefitinib (developed by AstraZeneca under the trade name Iressa®) and erlotinib (developed by Genentech under the trade name Tarceva®). Particular chemotherapeutic agents include, but are not limited to, cisplatin, carboplatin, oxaliplatin, DWA2114R, NK121, IS 3 295, and 254-S vincristine, prednisone, doxorubicin and L-asparaginase; mechlorethamine, vincristine, procarbazine and prednisone (MOPP), cyclophosphamide, vincristine, procarbazine and prednisone (C-MOPP), bleomycin, vinblastine, gemcitabine and 5-flurouracil. Exemplary chemotherapeutic agents are, for example, cisplatin, carboplatin, oxaliplatin, DWA2114R, NK121, IS 3 295, and 254-S. In a non-limiting example, a vaccinia virus, such as a vaccinia virus provided herein, is administered to a subject having a tumor, cancer or metastasis in combination with a platinum coordination complex, such as cisplatin, carboplatin, oxaliplatin, DWA2114R, NK121, IS 3 295, and 254-S. Tumors, cancers and metastasis can be any of those provided herein, and in particular, can be a pancreatic tumor, an ovarian tumor, a lung tumor, a colon tumor, a prostate tumor, a cervical tumor or a breast tumor; exemplary tumors are pancreatic and ovarian tumors. Tumors, cancers and metastasis can be a monotherapy-resistant tumor such as, for example, one that does not respond to therapy with virus alone or anti-cancer agent alone, but that does respond to therapy with a combination of virus and anti-cancer agent. Typically, a therapeutically effective amount of virus is systemically administered to the subject and the virus localizes and accumulates in the tumor. Subsequent to administering the virus, the subject is administered a therapeutically effective amount of an anti-cancer agent, such as cisplatin. In one example, cisplatin is administered once-daily for five consecutive days. One of skill in the art could determine when to administer the anti-cancer agent subsequent to the virus using, for example, in vivo animal models. Using the methods provided herein, administration of a virus and anti-cancer agent, such as cisplatin can cause a reduction in tumor volume, can cause tumor growth to stop or be delayed or can cause the tumor to be eliminated from the subject. The status of tumors, cancers and metastasis following treatment can be monitored using any of the methods provided herein and known in the art.

Exemplary anti-cancer antibiotics include, but are not limited to, anthracyclines such as doxorubicin hydrochloride (adriamycin), idarubicin hydrochloride, daunorubicin hydrochloride, aclarubicin hydrochloride, epirubicin hydrochloride and pirarubicin hydrochloride, phleomycins such as phleomycin and peplomycin sulfate, mitomycins such as mitomycin C, actinomycins such as actinomycin D, zinostatinstimalamer and polypeptides such as neocarzinostatin. In one example, a vaccinia virus, such as a vaccinia virus provided herein, is administered to a subject having a tumor, cancer or metastasis in combination with an anti-cancer antibiotic.

In one example, nanoparticles can be designed such that they carry one or more therapeutic agents provided herein. Additionally, nanoparticles can be designed to carry a molecule that targets the nanoparticle to the tumor cells. In one non-limiting example, nanoparticles can be coated with a radionuclide and, optionally, an antibody immunoreactive with a tumor-associated antigen. In one example, a vaccinia virus, such as a vaccinia virus provided herein, is administered to a subject having a tumor, cancer or metastasis in combination with a nanoparticle carrying any of the therapeutic agents provided herein.

Radiation therapy has become a foremost choice of treatment for a majority of cancer patients. The wide use of radiation treatment stems from the ability of gamma-irradiation to induce irreversible damage in targeted cells with the preservation of normal tissue function. Ionizing radiation triggers apoptosis, the intrinsic cellular death machinery in cancer cells, and the activation of apoptosis seems to be the principal mode by which cancer cells die following exposure to ionizing radiation. In one example, a vaccinia virus, such as a vaccinia virus provided herein, is administered to a subject having a tumor, cancer or metastasis in combination with radiation therapy.

Thus, provided herein are methods of administering to a subject one or more therapeutic compounds that can act in conjunction with the virus to increase the proliferation, toxicity, tumor cell killing, or immune response eliciting properties of a virus. Also provided herein are methods of administering to a subject one or more therapeutic compounds that can act in conjunction with the virus to decrease the proliferation, toxicity, or cell killing properties of a virus. Therapeutic compounds to be administered can be any of those provided herein or in the art.

Therapeutic compounds that can act in conjunction with the virus to increase the proliferation, toxicity, tumor cell killing or immune response eliciting properties of a virus are compounds that can alter gene expression, where the altered gene expression can result in an increased killing of tumor cells or an increased anti-tumor immune response in the subject. A gene expression-altering compound can, for example, cause an increase or decrease in expression of one or more viral genes, including endogenous viral genes and/or exogenous viral genes. For example, a gene expression-altering compound can induce or increase transcription of a gene in a virus such as an exogenous gene that can cause cell lysis or cell death, that can provoke an immune response, that can catalyze conversion of a prodrug-like compound, or that can inhibit expression of a tumor cell gene. Any of a wide variety of compounds that can alter gene expression are known in the art, including IPTG and RU486. Exemplary genes whose expression can be up-regulated include proteins and RNA molecules, including toxins, enzymes that can convert a prodrug to an anti-tumor drug, cytokines, transcription regulating proteins, siRNA and ribozymes. In another example, a gene expression-altering compound can inhibit or decrease transcription of a gene in a virus such as a heterologous gene that can reduce viral toxicity or reduces viral proliferation. Any of a variety of compounds that can reduce or inhibit gene expression can be used in the methods provided herein, including siRNA compounds, transcriptional inhibitors or inhibitors of transcriptional activators. Exemplary genes whose expression can be down-regulated include proteins and RNA molecules, including viral proteins or RNA that suppress lysis, nucleotide synthesis or proliferation, and cellular proteins or RNA molecules that suppress cell death, immunoreactivity, lysis, or viral replication.

In another example, therapeutic compounds that can act in conjunction with the virus to increase the proliferation, toxicity, tumor cell killing, or immune response eliciting properties of a virus are compounds that can interact with a virally expressed gene product, and such interaction can result in an increased killing of tumor cells or an increased anti-tumor immune response in the subject. A therapeutic compound that can interact with a virally-expressed gene product can include, for example a prodrug or other compound that has little or no toxicity or other biological activity in its subject-administered form, but after interaction with a virally expressed gene product, the compound can develop a property that results in tumor cell death, including but not limited to, cytotoxicity, ability to induce apoptosis, or ability to trigger an immune response. In one non-limiting example, the virus carries an enzyme into the cancer cells. Once the enzyme is introduced into the cancer cells, an inactive form of a chemotherapy drug (i.e., a prodrug) is administered. When the inactive prodrug reaches the cancer cells, the enzyme converts the prodrug into the active chemotherapy drug, so that it can kill the cancer cell. Thus, the treatment is targeted only to cancer cells and does not affect normal cells. The prodrug can be administered concurrently with, or sequentially to, the virus. A variety of prodrug-like substances are known in the art and an exemplary set of such compounds are disclosed elsewhere herein, where such compounds can include gancyclovir, 5-fluorouracil, 6-methylpurine deoxyriboside, cephalosporin-doxorubicin, 4-[(2-chloroethyl)(2-mesyloxyethyl)amino]benzoyl-L-glutamic acid, acetaminophen, indole-3-acetic acid, CB1954, 7-ethyl-10-[4-(1-piperidino)-1-piperidino]carbonyloxycamptothecin, bis-(2-chloroethyl)amino-4-hydroxyphenyl-aminomethanone 28, 1-chloromethyl-5-hydroxy-1,2-dihydro-3,4-benz[e]indole, epirubicin-glucuronide, 5'-deoxy-5-fluorouridine, cytosine arabinoside, linamarin, and a nucleoside analogue (e.g., fluorouridine, fluorodeoxyuridine, fluorouridine arabinoside, cytosine arabinoside, adenine arabinoside, guanine arabinoside, hypoxanthine arabinoside, 6-mercaptopurineriboside, theoguanosine riboside, nebularine, 5-iodouridine, 5-iododeoxyuridine, 5-bromodeoxyuridine, 5-vinyldeoxyuridine, 9-[(2-hydroxy)ethoxy]methylguanine (acyclovir), 9-[(2-hydroxy-1-hydroxymethyl)-ethoxy]methylguanine (DHPG), azauridien, azacytidine, azidothymidine, dideoxyadenosine, dideoxycytidine, dideoxyinosine, dideoxyguanosine, dideoxythymidine, 3'-deoxyadenosine, 3'-deoxycytidine, 3'-deoxyinosine, 3'-deoxyguanosine, 3'-deoxythymidine).

In another example, therapeutic compounds that can act in conjunction with the virus to decrease the proliferation, toxicity or cell killing properties of a virus are compounds that can inhibit viral replication, inhibit viral toxins or cause viral death. A therapeutic compound that can inhibit viral replication, inhibit viral toxins, or cause viral death can generally include a compound that can block one or more steps in the viral life cycle, including, but not limited to, compounds that can inhibit viral DNA replication, viral RNA transcription, viral coat protein assembly, outer membrane or polysaccharide assembly. Any of a variety of compounds that can block one or more steps in a viral life cycle are known in the art, including any known antiviral compound (e.g., cidofovir), viral DNA polymerase inhibitors, viral RNA polymerase inhibitors, inhibitors of proteins that regulate viral DNA replication or RNA transcription. In another example, a virus can contain a gene encoding a viral life cycle protein, such as DNA polymerase or RNA polymerase that can be inhibited by a compound that is, optionally, non-toxic to the host organism.

In addition to combination therapy between chemotherapeutic agents and a virus provided herein, other more complex combination therapy strategies could be applied as well. For example, a combination therapy can include chemotherapeutic agents, therapeutic antibodies, and a virus provided herein. Alternatively, another combination therapy can be the combination of radiation, therapeutic antibodies, and a virus provided herein. Therefore, the concept of combination therapy also can be based on the application of a virus provided herein virus along with one or more of the following therapeutic modalities, namely, chemotherapeutic agents, radiation therapy, therapeutic antibodies, hyper- or hypothermia therapy, siRNA, diagnostic/therapeutic bacteria, diagnostic/therapeutic mammalian cells, immunotherapy, and/or targeted toxins (delivered by antibodies, liposomes and nanoparticles).

Effective delivery of each components of the combination therapy is an important aspect of the methods provided herein. In accordance with one aspect, the modes of administration discussed below exploit one of more of the key features: (i) delivery of a virus provided herein to the tumors by a mode of administration effect to achieve highest titer of virus and highest therapeutic effect; (ii) delivery of any other mentioned therapeutic modalities to the tumor by a mode of administration to achieve the optimal therapeutic effect. The dose scheme of the combination therapy administered is such that the combination of the two or more therapeutic modalities is therapeutically effective. Dosages will vary in accordance with such factors as the age, health, sex, size and weight of the patient, the route of administration, the toxicity of the drugs, frequency of treatment and the relative susceptibilities of the cancer to each of the therapeutic modalities.

For combination therapies with chemotherapeutic compounds, dosages for the administration of such compounds are known in the art or can be determined by one skilled in the art according to known clinical factors (e.g., subject's species, size, body surface area, age, sex, immunocompetence, and general health, duration and route of administration, the kind and stage of the disease, for example, tumor size, and other viruses, treatments, or compounds, such as other chemotherapeutic drugs, being administered concurrently). In addition to the above factors, such levels can be affected by the infectivity of the virus, and the nature of the virus, as can be determined by one skilled in the art. For example, cisplatin (also called cis-platinum, platinol; cis-diamminedichloroplatinum; and cDDP) is representative of a broad class of water-soluble, platinum coordination compounds frequently employed in the therapy of testicular cancer, ovarian tumors and a variety of other cancers. (See, e.g., Blumenreich et al. *Cancer* 55(5): 1118-1122 (1985); Forastiere et al. *J. Clin. Oncol.* 19(4): 1088-1095 (2001)). Methods of employing cisplatin clinically are well known in the art. For example, cisplatin has been administered in a single day over a six hour period, once per month, by slow intravenous infusion. For localized lesions, cisplatin can be administered by local injection. Intraperitoneal infusion can also be employed. Cisplatin can be administered in doses as low as 10 mg/m$^2$ per treatment if part of a multi-drug regimen, or if the patient has an adverse reaction to higher dosing. In general, a clinical dose is from about 30 to about 120 or 150 mg/m$^2$ per treatment.

Typically, platinum-containing chemotherapeutic agents are administered parenterally, for example by slow intravenous infusion, or by local injection, as discussed above. The effects of intralesional (intra-tumoral) and IP administration of cisplatin is described in (Nagase et al. *Cancer Treat. Rep.* 71(9): 825-829 (1987); and Theon et al. *J. Am. Vet. Med. Assoc.* 202(2): 261-7. (1993)).

In one exemplary example, the virus is administered once, 2-6 times or more with 0-60 days apart each administration, followed by 1-30 days where no anti-cancer treatment, then cisplatin is administered daily for 1-5 days, followed by 1-30 days where no anti-cancer treatment is administered. Each component of the therapy, virus or cisplatin treatment, or the virus and cisplatin combination therapy can be repeated. In another exemplary example, cisplatin is administered daily for 1 to 5 days, followed by 1-10 days where no anti-cancer treatment is administered, then the virus is administered once or 2-6 times with 0-60 days apart. Such treatment scheme can be repeated. In another exemplary example, cisplatin is administered daily for 1 to 5 days, followed by 1-10 days where no anti-cancer treatment is administered, then the virus is administered once or 2-6 times with 0-60 days apart. This is followed by 5-60 days where no anti-cancer treatment is administered, then cisplatin is administered again for 1-5 days. Such treatment scheme can be repeated.

Gemcitabine (GEMZAR®) is another compound employed in the therapy of breast cancer, non-small cell lung cancer, and pancreatic cancer. Gemcitabine is a nucleoside analogue that exhibits antitumor activity. Methods of employing gemcitabine clinically are well known in the art. For example, gemcitabine has been administered by intravenous infusion at a dose of 1000 mg/m$^2$ over 30 minutes once weekly for up to 7 weeks (or until toxicity necessitates reducing or holding a dose), followed by a week of rest from treatment of pancreatic cancer. Subsequent cycles can include infusions once weekly for 3 consecutive weeks out of every 4 weeks. Gemcitabine has also been employed in combination with cisplatin in cancer therapy.

In one exemplary example, the virus is administered once or 2-6 times with 0-60 days apart, followed by 1-30 days where no anti-cancer treatment is administered, then gemcitabine is administered 1-7 times with 0-30 days apart, followed by 1-30 days where no anti-cancer treatment is administered. Such treatment scheme can be repeated. In another exemplary example, gemcitabine is administered 1-7 times with 0-30 days apart, followed by 1-10 days where no anti-cancer treatment is administered, then the virus is administered once or 2-6 times with 0-60 days apart. This is followed by 5-60 days where no anti-cancer treatment is administered. Such treatment scheme can be repeated. In another exemplary example, gemcitabine is administered 1-7 times with 0-30 days apart, followed by 1-10 days where no anti-cancer treatment is administered, then the virus is administered once or 2-6 times with 0-60 days apart. This is followed by 5-60 days where no anti-cancer treatment is administered, then gemcitabine is administered again for 1-7 times with 0-30 days apart. Such treatment scheme can be repeated.

As will be understood by one of skill in the art, the optimal treatment regimen will vary and it is within the scope of the treatment methods to evaluate the status of the disease under treatment and the general health of the patient prior to, and following one or more cycles of combination therapy in order to determine the optimal therapeutic combination.

iii. Immunotherapies and Biological Therapies

Therapeutic compounds also include, but are not limited to, compounds that exert an immunotherapeutic effect, stimulate or suppress the immune system, carry a therapeutic compound, or a combination thereof. Optionally, the therapeutic agent can exhibit or manifest additional properties, such as, properties that permit its use as an imaging agent, as described elsewhere herein. Such therapeutic compounds include, but are not limited to, anti-cancer antibodies, radiation therapy, siRNA molecules and compounds that suppress the immune system (i.e. immunosuppressors, immunosuppressive agents). In some cases, it is desirable to administer an immunosuppressive agent to a subject to suppress the immune system prior to the administration of the virus in order to minimize any adverse reactions to the virus. Exemplary immunosuppressive agents include, but are not limited to, glucocorticoids, alkylating agents, antimetabolites, interferons and immunosuppressive antibodies (e.g., anti-CD3 and anti-IL2 receptor antibodies).

Immunotherapy also includes for example, immune-stimulating molecules (protein-based or non-protein-based), cells and antibodies. Immunotherapy treatments can include stimulating immune cells to act more effectively or to make the tumor cells or tumor associated antigens recognizable to the immune system (i.e., break tolerance).

Cytokines and growth factors include, but are not limited to, interleukins, such as, for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factors (GM-CSF), angiogenins, and tissue factors.

Anti-cancer antibodies include, but are not limited to, Rituximab, ADEPT, Trastuzumab (Herceptin®), Tositumomab (Bexxar®), Cetuximab (Erbitux®), Ibritumomab (Zevalin®), Alemtuzumab (Campath®-1H), Epratuzumab (LymphoCide®), Gemtuzumab ozogamicin (Mylotarg®), Bevacimab (Avastin®), Tarceva® (Erlotinib), SUTENT® (sunitinib malate), Panorex® (Edrecolomab), RITUXAN® (Rituximab), Zevalin® (90Y-ibritumomab tiuexetan), Mylotarg® (Gemtuzumab Ozogamicin) and Campath® (Alemtuzumab).

Thus, provided herein are methods of administering to a subject one or more therapeutic compounds that can act in conjunction with the virus to stimulate or enhance the immune system, thereby enhancing the effect of the virus. Such immunotherapy can be either delivered as a separate therapeutic modality or could be encoded (if the immunotherapy is protein-based) by the administered virus.

Biological therapies are treatments that use natural body substances or drugs made from natural body substances. They can help to treat a cancer and control side effects caused by other cancer treatments such as chemotherapy. Biological therapies are also sometimes called Biological Response Modifiers (BRM's), biologic agents or simply "biologics" because they stimulate the body to respond biologically (or naturally) to cancer. Immunotherapy is treatment using natural substances that the body uses to fight infection and disease. Because it uses natural substances, immunotherapy is also a biological therapy. There are several types of drugs that come under the term biological therapy: these include, for example, monoclonal antibodies (mAbs), cancer vaccines, growth factors for blood cells, cancer growth inhibitors, anti-angiogenic factors, interferon alpha, interleukin-2 (IL-2), gene therapy and BCG vaccine for bladder cancer Monoclonal antibodies (mAbs) are of particular interest for treating cancer because of the specificity of binding to a unique antigen and the ability to produce large quantities in the laboratory for mass distribution. Monoclonal antibodies can be engineered to act in the same way as immune system proteins: that is, to seek out and kill foreign matter in your body, such as viruses. Monoclonal antibodies can be designed to recognize epitopes on the surface of cancer cells. The antibodies target specifically bind to the epitopes and either kill the cancer cells or deliver a therapeutic agent to the cancer cell. Methods of conjugating therapeutic agents to antibodies is well-known in the art. Different antibodies have to be made for different types of cancer; for example, Rituximab recognizes CD20 protein on the outside of non Hodgkin's lymphoma cells; ADEPT is a treatment using antibodies that recognize bowel (colon) cancer; and Trastuzumab (Herceptin®) recognizes breast cancer cells that produce too much of the protein HER 2 ("HER 2 positive"). Other antibodies include, for example, Tositumomab (Bexxar®), Cetuximab (Erbitux®), Ibritumomab (Zevalin®), Alemtuzumab (Campath®-1H), Epratuzumab (LymphoCide®), Gemtuzumab ozogamicin (Mylotarg®) and Bevacimab (Avastin®). Thus, the viruses provided herein can be administered concurrently with, or sequentially to, one or more monoclonal antibodies in the treatment of cancer. In one example, additional therapy is administered in the form of one or more of any of the other treatment modalities provided herein.

Rather than attempting to prevent infection, such as is the case with the influenza virus, cancer vaccines help treat the cancer once it has developed. The aim of cancer vaccines is to stimulate the immune response. Cancer vaccines include, for example, antigen vaccines, whole cell vaccines, dendritic cell vaccines, DNA vaccines and anti-idiotype vaccines. Antigen vaccines are vaccines made from tumor-associated antigens in, or produced by, cancer cells. Antigen vaccines stimulate a subject's immune system to attack the cancer. Whole cell vaccines are vaccines that use the whole cancer cell, not just a specific antigen from it, to make the vaccine. The vaccine is made from a subject's own cancer cells, another subject's cancer cells or cancer cells grown in a laboratory. The cells are treated in the laboratory, usually with radiation, so that they can't grow, and are administered to the subject via injection or through an intravenous drip into the bloodstream so they can stimulate the immune system to attack the cancer. One type of whole cell vaccine is a dendritic cell vaccine, which help the immune system to recognize and attack abnormal cells, such as cancer cells. Dendritic cell vaccines are made by growing dendritic cells alongside the cancer cells in the lab. The vaccine is administered to stimulate the immune system to attack the cancer. Anti-idiotype vaccines are vaccines that stimulate the body to make antibodies against cancer cells. Cancer cells make some tumor-associated antigens that the immune system recognizes as foreign. But because cancer cells are similar to non-cancer cells, the immune system can respond weakly. DNA vaccines boost the immune response. DNA vaccines are made from DNA from cancer cells that carry the genes for the tumor-associated antigens. When a DNA vaccine is injected, it enables the cells of the immune system to recognize the tumor-associated antigens, and activates the cells in the immune system (i.e., breaking tolerance). The most promising results from using DNA vaccines are in treating melanoma. Thus, the viruses provided herein can be administered concurrently with, or sequentially to, a whole cell vaccine in the treatment of cancer. In one example, additional therapy is administered in the form of one or more of any of the other treatment modalities provided herein.

Growth factors are natural substances that stimulate the bone marrow to make blood cells. Recombinant technology can be used to generate growth factors which can be administered to a subject to increase the number of white blood cells, red blood cells and stem cells in the blood. Growth factors used in cancer treatment to boost white blood cells include Granulocyte Colony Stimulating Factor (G-CSF) also called filgrastim (Neupogen®) or lenograstim (Granocyte®) and Granulocyte and Macrophage Colony Stimulating Factor (GM-CSF), also called molgramostim. A growth factor to help treat anemia is erythropoietin (EPO). EPO encourages the body to make more red blood cells, which in turn, increases hemoglobin levels and the levels of oxygen in body tissues. Other growth factors are being developed which can boost platelets. Thus, the viruses provided herein can be administered concurrently with, or sequentially to, a growth factor such as GM-CSF, in the treatment of cancer. In one example, additional therapy is administered in the form of one or more of any of the other treatment modalities provided herein.

Cancer growth inhibitors use cell-signaling molecules which control the growth and multiplication of cells, such as cancer cells. Drugs that block these signaling molecules can stop cancers from growing and dividing. Cancer growth factors include, but are not limited to, tyrosine kinases. Thus, drugs that block tyrosine kinases are tyrosine kinase inhibitors (TKIs). Examples of TKIs include, but are not limited to, Erlotinib (Tarceva®, OSI-774), Gefitinib (Iressa®, ZD 1839) and Imatinib (Glivec®, STI 571). Another type of growth inhibitor is Bortezomib (Velcade®) for multiple myeloma and for some other cancers. Velcade® is a proteasome inhibitor. Proteasomes are found in all cells and help break down proteins in cells. Interfering with the action of proteosomes causes a build up of proteins in the cell to toxic levels; thereby killing the cancer cells. Cancer cells are more sensitive to Velcade® than normal cells. Thus, the viruses provided herein can be administered concurrently with, or sequentially to, a cancer growth inhibitor, such as Velcade®, in the treatment of cancer. In one example, additional therapy is administered in the form of one or more of any of the other treatment modalities provided herein.

Cancers need a blood supply to expand and grow their own blood vessels as they get bigger. Without its own blood supply, a cancer cannot grow due to lack of nutrients and oxygen. Anti-angiogenic drugs stop tumors from developing their own blood vessels. Examples of these types of drugs include, but are not limited to, Thalidomide, mainly for treating myeloma but also in trials for other types of cancer, and Bevacizumab (Avastin®), a type of monoclonal antibody that has been investigated for bowel cancer. Thus, the viruses provided herein can be administered concurrently with, or sequentially to, an anti-angiogenic drug in the treatment of cancer. In one example, additional therapy is administered in the form of one or more of any of the other treatment modalities provided herein.

Cancer growth inhibitors use cell-signaling molecules which control the growth and multiplication of cells, such as cancer cells. Drugs that block these signaling molecules can stop cancers from growing and dividing. Cancer growth factors include, but are not limited to, tyrosine kinases. Thus, drugs that block tyrosine kinases are tyrosine kinase inhibitors (TKIs). Examples of TKIs include, but are not limited to, Erlotinib (Tarceva, OSI-774), Iressa (Gefitinib, ZD 1839) and Imatinib (Glivec, STI 571). Another type of growth inhibitor is Bortezomib (Velcade) for multiple myeloma and for some other cancers. Velcade is a proteasome inhibitor. Proteasomes are found in all cells and help break down proteins in cells. Interfering with the action of proteosomes causes a build up of proteins in the cell to toxic levels; thereby killing the cancer cells. Cancer cells are more sensitive to Velcade than normal cells. Thus, the viruses provided herein can be administered concurrently with, or sequentially to, a cancer growth inhibitor, such as Velcade, in the treatment of cancer. In one example, additional therapy is administered in the form of one or more of any of the other treatment modalities provided herein.

Cancers need a blood supply to expand and grow their own blood vessels as they get bigger. Without its own blood supply, a cancer cannot grow due to lack of nutrients and oxygen. Anti-angiogenic drugs stop tumors from developing their own blood vessels. Examples of these types of drugs include, but are not limited to, Thalidomide, mainly for treating myeloma but also in trials for other types of cancer, and Bevacizumab (Avastin), a type of monoclonal antibody that has been investigated for bowel cancer. Thus, the viruses provided herein can be administered concurrently with, or sequentially to, an anti-angiogenic drug in the treatment of cancer. In one example, additional therapy is administered in the form of one or more of any of the other treatment modalities provided herein.

Interferon-alpha (IFN-α) is a natural substance produced in the body, in very small amounts, as part of the immune response. IFN-α is administered as a treatment to boost the immune system and help fight cancers such as renal cell (kidney) cancer, malignant melanoma, multiple myeloma and some types of leukemias. IFN-α works in several ways: it can help to stop cancer cells growing, it can also boost the immune system to help it attack the cancer, and it can affect the blood supply to the cancer cells. Thus, the viruses provided herein can be administered concurrently with, or sequentially to, IFN-α in the treatment of cancer. In one example, additional therapy is administered in the form of one or more of any of the other treatment modalities provided herein.

Administration of IL-2 is a biological therapy drug because it is naturally produced by the immune system. Thus, it is also an immunotherapy. Interleukin 2 is used in treating renal cell (kidney) cancer, and is being tested in clinical trials for several other types of cancers. IL-2 works directly on cancer cells by interfering with cell grow and proliferation; it stimulates the immune system by promoting the growth of killer T cells and other cells that attack cancer cells; and it also stimulates cancer cells to secrete chemoattractants that attract immune system cells. IL-2 is generally administered as a subcutaneous injection just under the skin once daily for 5 days, followed by 2 days rest. The cycle of injections is repeated for 4 weeks followed by a week without treatment. The treatment regimen and the number of cycles administered depends on the type of cancer and how it responds to the treatment. IL-2 can be self-administered or administered by a health professional. Alternatively, IL-2 can be administered intravenously via injection or drip. Thus, the viruses provided herein can be administered concurrently with, or sequentially to, IL-2 in the treatment of cancer. In one example, additional therapy is administered in the form of one or more of any of the other treatment modalities provided herein.

Gene therapy involves treating cancer by blocking abnormal genes in cancer cells, repairing or replacing abnormal genes in cancer cells, encouraging even more genes to become abnormal in cancer cells so that they die or become sensitive to treatment, using viruses to carry treatment-activating enzymes into the cancer cells, or a combination thereof. As a result, cancer cells die due to damage in the cell. Cancer cells develop as a result of several types of mutations in several of their genes. Targeted genes include, but are not limited to, those that encourage the cell to multiply (i.e., oncogenes), genes that stop the cell from multiplying (i.e., tumor suppressor genes) and genes that repair other damaged genes. Gene therapy can involve repair of damaged oncogenes or blocking the proteins that the oncogenes produce. The tumor suppressor gene, p53, is damaged in many human cancers. Viruses have been used to deliver an undamaged p53 gene into cancer cells, and early clinical trials are now in progress looking at treating cancers with modified p53-producing viruses. Gene therapy could be used to replace the damaged DNA repairing genes. In an alternative example, methods of increasing DNA damage within a tumor cell can promote death of the tumor cell or cause increased susceptibility of the tumor cell to other cancer treatments, such as radiotherapy or chemotherapy. Thus, the viruses provided herein can be administered concurrently with, or sequentially to, any of the gene therapy methods provided herein or known in the art in the treatment of cancer. In one example, additional therapy is administered in the form of one or more of any of the other treatment modalities provided herein.

Treatment of early stage bladder cancer is called intravesical treatment, which is mainly used to treat stage T1 bladder cancers that are high grade (grade 3 or G3) or carcinoma in situ of the bladder (also known as T is or CIS). BCG is a vaccine for tuberculosis (TB), which also has been found to be effective in treating CIS and preventing bladder cancers from recurring. In some cases, BCG vaccines have been used for treating grade 2 early bladder cancer. Because bladder cancer can occur anywhere in the bladder lining, it cannot be removed in the same way as the papillary early bladder cancers. Rather a BCG vaccine is administered using intravesical therapy; that is, first, a catheter (tube) put is inserted into the bladder, followed by intra-catheter administration of a BCG vaccine and/or a chemotherapy. BCG treatment occurs weekly for 6 weeks or more depending on the effect on the bladder cancer. BCG treatment of bladder cancer can be combined with other types of treatments, such as administration of chemotherapy (intravesical), IL-2, treatment with drugs that make cells sensitive to light, vitamins, and photodynamic therapy. Thus, the viruses provided herein can be administered concurrently with, or sequentially to, BCG vaccines in the treatment of cancer. In one example, additional therapy is administered in the form of one or more of any of the other treatment modalities provided herein.

e. State of Subject

In another example, the methods provided herein for administering a virus to a subject can be performed on a subject in any of a variety of states, including an anesthetized subject, an alert subject, a subject with elevated body temperature, a subject with reduced body temperature, or other state of the subject that is known to affect the accumulation of a virus in the tumor. As provided herein, it has been determined that a subject that is anesthetized can have a decreased rate of accumulation of a virus in a tumor relative to a subject that is not anesthetized. Further provided herein, it has been determined that a subject with decreased body temperature can have a decreased rate of accumulation of a virus in a tumor relative to a subject with a normal body temperature. Accordingly, provided herein are methods of administering a virus to a subject, where the methods can include administering a virus to a subject where the subject is not under anesthesia, such as general anesthesia; for example, the subject can be under local anesthesia, or can be unanesthetized. Also provided herein are methods of administering a virus to a subject, where the methods can include administering a virus to a subject with altered body temperature, where the alteration of the body temperature can influence the ability of the virus to accumulate in a tumor; typically, a decrease in body temperature can decrease the ability of a virus to accumulate in a tumor. Thus, in one exemplary example, a method is provided for administering a virus to a subject, where the method includes elevating the body temperature of the subject to a temperature above normal, and administering a virus to the subject, where the virus can accumulate in the tumor more readily in the subject with higher body temperature relative to the ability of the virus to accumulate in a tumor of a subject with a normal body temperature. In another example, localized elevations in temperature in the area surrounding the tumor can be used to increase the accumulation of the virus in the tumor.

4. Monitoring

The methods provided herein can further include one or more steps of monitoring the subject, monitoring the tumor, and/or monitoring the virus administered to the subject. Any of a variety of monitoring steps can be included in the methods provided herein, including, but not limited to, monitoring tumor size, monitoring anti-(tumor antigen) antibody titer, monitoring the presence and/or size of metastases, monitoring the subject's lymph nodes, monitoring the subject's weight or other health indicators including blood or urine markers, monitoring anti-(viral antigen) antibody titer, monitoring viral expression of a detectable gene product, and directly monitoring viral titer in a tumor, tissue or organ of a subject.

The purpose of the monitoring can be simply for assessing the health state of the subject or the progress of therapeutic treatment of the subject, or can be for determining whether or not further administration of the same or a different virus is warranted, or for determining when or whether or not to administer a compound to the subject where the compound can act to increase the efficacy of the therapeutic method, or the compound can act to decrease the pathogenicity of the virus administered to the subject.

a. Monitoring Viral Gene Expression

In some examples, the methods provided herein can include monitoring one or more virally expressed genes. Viruses can express one or more detectable gene products, including but not limited to, detectable proteins (e.g. luminescent or fluorescent proteins) or proteins that induce a detectable signal (e.g. proteins that bind or transport detectable compounds or modify substrates to produce a signal). The infected cells/tissue can thus be imaged by one more optical or non-optical imaging methods.

As provided herein, measurement of a detectable gene product expressed by a virus can provide an accurate determination of the level of virus present in the subject. As further provided herein, measurement of the location of the detectable gene product, for example, by imaging methods including, but not limited to, magnetic resonance, fluorescence, and tomographic methods, can determine the localization of the virus in the subject. Accordingly, the methods provided herein that include monitoring a detectable viral gene product can be used to determine the presence or absence of the virus in one or more organs or tissues of a subject, and/or the presence or absence of the virus in a tumor or metastases of a subject. Further, the methods provided herein that include monitoring a detectable viral gene product can be used to determine the titer of virus present in one or more organs, tissues, tumors or metastases. Methods that include monitoring the localization and/or titer of viruses in a subject can be used for determining the pathogenicity of a virus; since viral infection, and particularly the level of infection, of normal tissues and organs can indicate the pathogenicity of the probe, methods of monitoring the localization and/or amount of viruses in a subject can be used to determine the pathogenicity of a virus. Since methods provided herein can be used to monitor the amount of viruses at any particular location in a subject, the methods that include monitoring the localization and/or titer of viruses in a subject can be performed at multiple time points, and, accordingly can determine the rate of viral replication in a subject, including the rate of viral replication in one or more organs or tissues of a subject; accordingly, the methods of monitoring a viral gene product can be used for determining the replication competence of a virus. The methods provided herein also can be used to quantitate the amount of virus present in a variety of organs or tissues, and tumors or metastases, and can thereby indicate the degree of preferential accumulation of the virus in a subject; accordingly, the viral gene product monitoring methods provided herein can be used in methods of determining the ability of a virus to accumulate in tumor or metastases in preference to normal tissues or organs. Since the viruses used in the methods provided herein can accumulate in an entire tumor or can accumulate at multiple sites in a tumor, and can also accumulate in metastases, the methods provided herein for monitoring a viral gene product can be used to determine the size of a tumor or the number of metastases that are present in a subject. Monitoring such presence of viral gene product in tumor or metastasis over a range of time can be used to assess changes in the tumor or metastasis, including growth or shrinking of a tumor, or development of new metastases or disappearance of metastases, and also can be used to determine the rate of growth or shrinking of a tumor, or development of new metastases or disappearance of metastases, or the change in the rate of growth or shrinking of a tumor, or development of new metastases or disappearance of metastases. Accordingly, the methods of monitoring a viral gene product can be used for monitoring a neoplastic disease in a subject, or for determining the efficacy of treatment of a neoplastic disease, by determining rate of growth or shrinking of a tumor, or development of new metastases or disappearance of metastases, or the change in the rate of growth or shrinking of a tumor, or development of new metastases or disappearance of metastases.

Any of a variety of detectable proteins can be detected in the monitoring methods provided herein; an exemplary, non-limiting list of such detectable proteins includes any of a variety of fluorescent proteins (e.g., green or red fluorescent proteins), any of a variety of luciferases, transferrin or other iron binding proteins; or receptors, binding proteins, and antibodies, where a compound that specifically binds the receptor, binding protein or antibody can be a detectable agent or can be labeled with a detectable substance (e.g., a radionuclide or imaging agent); or transporter proteins (e.g. hNET or hNIS) that can bind to and transport detectable molecules into the cell. Viruses expressing a detectable protein can be detected by a combination of the method provided herein and know in the art. Viruses expressing more than one detectable protein or two or more viruses expressing various detectable protein can be detected and distinguished by dual imaging methods. For example, a virus expressing a fluorescent protein and an iron binding protein can be detected in vitro or in vivo by low light fluorescence imaging and magnetic resonance, respectively. In another example, a virus expressing two or more fluorescent proteins can be detected by fluorescence imaging at different wavelength. In vivo dual imaging can be performed on a subject that has been administered a virus expressing two or more detectable gene products or two or more viruses each expressing one or more detectable gene products.

b. Monitoring Tumor Size

Also provided herein are methods of monitoring tumor and/or metastasis size and location. Tumor and or metastasis size can be monitored by any of a variety of methods known in the art, including external assessment methods or tomographic or magnetic imaging methods. In addition to the methods known in the art, methods provided herein, for example, monitoring viral gene expression, can be used for monitoring tumor and/or metastasis size.

Monitoring size over several time points can provide information regarding the increase or decrease in size of a tumor or metastasis, and can also provide information regarding the presence of additional tumors and/or metastases in the subject. Monitoring tumor size over several time points can provide information regarding the development of a neoplastic disease in a subject, including the efficacy of treatment of a neoplastic disease in a subject.

c. Monitoring Antibody Titer

The methods provided herein also can include monitoring the antibody titer in a subject, including antibodies produced in response to administration of a virus to a subject. The viruses administered in the methods provided herein can elicit an immune response to endogenous viral antigens. The viruses administered in the methods provided herein also can elicit an immune response to exogenous genes expressed by a virus. The viruses administered in the methods provided herein also can elicit an immune response to tumor antigens. Monitoring antibody titer against viral antigens, viral expressed exogenous gene products, or tumor antigens can be used in methods of monitoring the toxicity of a virus, monitoring the efficacy of treatment methods, or monitoring the level of gene product or antibodies for production and/or harvesting.

In one example, monitoring antibody titer can be used to monitor the toxicity of a virus. Antibody titer against a virus can vary over the time period after administration of the virus to the subject, where at some particular time points, a low anti-(viral antigen) antibody titer can indicate a higher toxicity, while at other time points a high anti-(viral antigen) antibody titer can indicate a higher toxicity. The viruses used in the methods provided herein can be immunogenic, and can, therefore, elicit an immune response soon after administering the virus to the subject. Generally, a virus against which a subject's immune system can quickly mount a strong immune response can be a virus that has low toxicity when the subject's immune system can remove the virus from all normal organs or tissues. Thus, in some examples, a high antibody titer against viral antigens soon after administering the virus to a subject can indicate low toxicity of a virus. In contrast, a virus that is not highly immunogenic can infect a host organism without eliciting a strong immune response, which can result in a higher toxicity of the virus to the host. Accordingly, in some examples, a high antibody titer against viral antigens soon after administering the virus to a subject can indicate low toxicity of a virus.

In other examples, monitoring antibody titer can be used to monitor the efficacy of treatment methods. In the methods provided herein, antibody titer, such as anti-(tumor antigen) antibody titer, can indicate the efficacy of a therapeutic method such as a therapeutic method to treat neoplastic disease. Therapeutic methods provided herein can include causing or enhancing an immune response against a tumor and/or metastasis. Thus, by monitoring the anti-(tumor antigen) antibody titer, it is possible to monitor the efficacy of a therapeutic method in causing or enhancing an immune response against a tumor and/or metastasis. The therapeutic methods provided herein also can include administering to a subject a virus that can accumulate in a tumor and can cause or enhance an anti-tumor immune response. Accordingly, it is possible to monitor the ability of a host to mount an immune response against viruses accumulated in a tumor or metastasis, which can indicate that a subject has also mounted an anti-tumor immune response, or can indicate that a subject is likely to mount an anti-tumor immune response, or can indicate that a subject is capable of mounting an anti-tumor immune response.

In other examples, monitoring antibody titer can be used for monitoring the level of gene product or antibodies for production and/or harvesting. As provided herein, methods can be used for producing proteins, RNA molecules or other compounds by expressing an exogenous gene in a virus that has accumulated in a tumor. Further provided herein are methods for producing antibodies against a protein, RNA molecule or other compound produced by exogenous gene expression of a virus that has accumulated in a tumor. Monitoring antibody titer against the protein, RNA molecule or other compound can indicate the level of production of the protein, RNA molecule or other compound by the tumor-accumulated virus, and also can directly indicate the level of antibodies specific for such a protein, RNA molecule or other compound.

d. Monitoring General Health Diagnostics

The methods provided herein also can include methods of monitoring the health of a subject. Some of the methods provided herein are therapeutic methods, including neoplastic disease therapeutic methods. Monitoring the health of a subject can be used to determine the efficacy of the therapeutic method, as is known in the art. The methods provided herein also can include a step of administering to a subject a virus. Monitoring the health of a subject can be used to determine the pathogenicity of a virus administered to a subject. Any of a variety of health diagnostic methods for monitoring disease such as neoplastic disease, infectious disease, or immune-related disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, or reactive protein concentration.

e. Monitoring Coordinated with Treatment

Also provided herein are methods of monitoring a therapy, where therapeutic decisions can be based on the results of the monitoring. Therapeutic methods provided herein can include administering to a subject a virus, where the virus can preferentially accumulate in a tumor and/or metastasis, and where the virus can cause or enhance an anti-tumor immune response. Such therapeutic methods can include a variety of steps including multiple administrations of a particular virus, administration of a second virus, or administration of a therapeutic compound. Determination of the amount, timing or type of virus or compound to administer to the subject can be based on one or more results from monitoring the subject. For example, the antibody titer in a subject can be used to determine whether or not it is desirable to administer a virus or compound, the quantity of virus or compound to administer, and the type of virus or compound to administer, where, for example, a low antibody titer can indicate the desirability of administering additional virus, a different virus, or a therapeutic compound such as a compound that induces viral gene expression. In another example, the overall health state of a subject can be used to determine whether or not it is desirable to administer a virus or compound, the quantity of virus or compound to administer, and the type of virus or compound to administer, where, for example, determining that the subject is healthy can indicate the desirability of administering additional virus, a different virus, or a therapeutic compound such as a compound that induces viral gene expression. In another example, monitoring a detectable virally expressed gene product can be used to determine whether or not it is desirable to administer a virus or compound, the quantity of virus or compound to administer, and the type of virus or compound to administer. Such monitoring methods can be used to determine whether or not the therapeutic method is effective, whether or not the therapeutic method is pathogenic to the subject, whether or not the virus has accumulated in a tumor or metastasis, and whether or not the virus has accumulated in normal tissues or organs. Based on such determinations, the desirability and form of further therapeutic methods can be derived.

In one example, determination of whether or not a therapeutic method is effective can be used to derive further therapeutic methods. Any of a variety of methods of monitoring can be used to determine whether or not a therapeutic method is effective, as provided herein or otherwise known in the art. If monitoring methods indicate that the therapeutic method is effective, a decision can be made to maintain the current course of therapy, which can include further administrations of a virus or compound, or a decision can be made that no further administrations are required. If monitoring methods indicate that the therapeutic method is ineffective, the monitoring results can indicate whether or not a course of treatment should be discontinued (e.g., when a virus is pathogenic to the subject), or changed (e.g., when a virus accumulates in a tumor without harming the host organism, but without eliciting an anti-tumor immune response), or increased in frequency or amount (e.g., when little or no virus accumulates in tumor).

In one example, monitoring can indicate that a virus is pathogenic to a subject. In such instances, a decision can be made to terminate administration of the virus to the subject, to administer lower levels of the virus to the subject, to administer a different virus to a subject, or to administer to a subject a compound that reduces the pathogenicity of the virus. In one example, administration of a virus that is determined to be pathogenic can be terminated. In another example, the dosage amount of a virus that is determined to be pathogenic can be decreased for subsequent administration; in one version of such an example, the subject can be pre-treated with another virus that can increase the ability of the pathogenic virus to accumulate in tumor, prior to re-administering the pathogenic virus to the subject. In another example, a subject can have administered thereto a virus that is pathogenic to the subject; administration of such a pathogenic virus can be accompanied by administration of, for example, an antiviral compound (e.g., cidofovir), pathogenicity attenuating compound (e.g., a compound that down-regulates the expression of a lytic or apoptotic gene product), or other compound that can decrease the proliferation, toxicity, or cell killing properties of a virus, as described herein elsewhere. In one variation of such an example, the localization of the virus can be monitored, and, upon determination that the virus is accumulated in tumor and/or metastases but not in normal tissues or organs, administration of the antiviral compound or pathogenicity attenuating compound can be terminated, and the pathogenic activity of the virus can be activated or increased, but limited to the tumor and/or metastasis. In another variation of such an example, after terminating administration of the antiviral compound or pathogenicity attenuating compound, the presence of the virus and/or pathogenicity of the virus can be further monitored, and administration of such a compound can be reinitiated if the virus is determined to pose a threat to the host by, for example, spreading to normal organs or tissues, releasing a toxin into the vasculature, or otherwise having pathogenic effects reaching beyond the tumor or metastasis.

In another example, monitoring can determine whether or not a virus has accumulated in a tumor or metastasis of a subject. Upon such a determination, a decision can be made to further administer additional virus, a different virus or a compound to the subject. In another example, monitoring the presence of a virus in a tumor can be used in deciding to administer to the subject a compound, where the compound can increase the pathogenicity, proliferation, or immunogenicity of a virus or the compound can otherwise act in conjunction with the virus to increase the proliferation, toxicity, tumor cell killing, or immune response eliciting properties of a virus; in one variation of such an example, the virus can, for example, have little or no lytic or cell killing capability in the absence of such a compound; in a further variation of such an example, monitoring of the presence of the virus in a tumor or metastasis can be coupled with monitoring the absence of the virus in normal tissues or organs, where the compound is administered if the virus is present in tumor or metastasis and not at all present or substantially not present in normal organs or tissues; in a further variation of such an example, the amount of virus in a tumor or metastasis can be monitored, where the compound is administered if the virus is present in tumor or metastasis at sufficient levels.

H. EXAMPLES

The following examples are included for illustrative purposes only and are not intended to limit the scope of the invention.

Example 1

Isolation of Clonal Isolates of LIVP

African green monkey kidney fibroblast CV-1 cells (ATCC® No. CCL-70™; American Type Culture Collection (Manassas, Va.)) were plated in a 6-well plate at $5 \times 10^5$ cells per well and grown in Dulbecco's modified Eagle's medium (DMEM, Mediatech, Inc., Herndon, Va.) supplemented with 1% antibiotic-antimycotic solution (Mediatech, Inc., Herndon, Va.) and 10% fetal bovine serum (FBS, Mediatech, Inc., Herndon, Va.) overnight at 37° C. in a humidified incubator supplied with 5% $CO_2$ when cells reached 90% confluency. CV-1 cells were infected with 10-fold serial dilutions of the vaccinia virus LIVP (a vaccinia virus strain, originally derived by adapting the Lister strain (ATCC® Catalog No. VR-1549™) to calf skin (Institute of Viral Preparations, Moscow, Russia, Al'tshtein et al., (1983) *Dokl. Akad. Nauk USSR* 285:696-699)) in duplicate. Serial dilutions were employed for infection to ensure isolation of well-separated plaques. Two days post infection, eight well-isolated plaques exhibiting a large plaque phenotype relative to the other plaques on the plate were picked. These plaques were subjected to two more rounds of plaque purification in CV-1 cells and designated as LIVP clonal isolates 1.1.1, 2.1.1, 3.1.1, 4.1.1, 5.1.1, 6.1.1, 7.1.1, and 8.1.1, respectively. LIVP 1.1.1 and 4.1.1 formed larger plaques in CV-1 cells than other isolates.

Example 2

In Vitro Infection of Various Normal and Cancer Cell Lines

The growth of the LIVP clonal isolates in various normal and cancer cell types was analyzed and compared to the growth of the parent LIVP strain, two derivative strains of LIVP, GLV-1h68 (see U.S. Pat. No. 7,588,767) and GLV-1h74 (see U.S. Patent Pub. Nos. 2009-0098529 and 2009-0053244), and vaccinia virus WR (ATCC® Catalog No. VR-1354™). GLV-1h68 contains DNA insertions in gene loci of the LIVP strain (SEQ ID NO: 9). GLV-1h68 contains expression cassettes encoding detectable marker proteins in the F14.5L (also designated in LIVP as F3), thymidine kinase (TK) and hemagglutinin (HA) gene loci. An expression cassette containing a Ruc-GFP cDNA molecule (a fusion of DNA encoding *Renilla* luciferase and DNA encoding GFP) under the control of a vaccinia synthetic early/late promoter $P_{SEL}$ (($P_{SEL}$)Ruc-GFP) was inserted into the F14.5L gene locus; an expression cassette containing a DNA molecule encoding beta-galactosidase under the control of the vaccinia early/late promoter $P_{7.5k}$ (($P_{7.5k}$)LacZ) and DNA encoding a rat transferrin receptor positioned in the reverse orientation for transcription relative to the vaccinia synthetic early/late promoter $P_{SEL}$ (($P_{SEL}$)rTrfR) was inserted into the TK gene locus (the resulting virus does not express transferrin receptor protein since the DNA molecule encoding the protein is positioned in the reverse orientation for transcription relative to the promoter in the cassette); and an expression cassette containing a DNA molecule encoding β-glucuronidase under the control of the vaccinia late promoter $P_{11k}$ (($P_{11k}$)gusA) was inserted into the HA gene locus. GLV-1h74 that was derived from GLV-1h68 by deletion of all three inserts at F14.5L, J2R, and A56R loci. GLV-1h74 contains a non-coding DNA molecule inserted into the F14.5L gene locus in place of ($P_{SEL}$)Ruc-GFP, a non-coding DNA molecule inserted into the TK gene locus in place of ($P_{SEL}$)rTrfR and ($P_{7.5k}$)LacZ, and a non-coding DNA molecule inserted into the HA gene locus in place of ($P_{11k}$)gusA.

The cell lines were infected with the viruses as indicated below and viral yield was determined by titration on CV-1 cells (ATCC® No. CCL-70™; American Type Culture Collection (Manassas, Va.)) grown in Dulbecco's modified Eagle's medium (DMEM, Mediatech, Inc., Herndon, Va.) supplemented with 1% antibiotic-antimycotic solution (Mediatech, Inc., Herndon, Va.) and 10% fetal bovine serum (FBS, Mediatech, Inc., Herndon, Va.).

A. Normal Cell Lines

1. MEF Mouse Embryonic Fibroblast Cells

MEF cells (StemCell Technologies, Vancouver, Canada; Catalog #00321) were grown in Dulbecco's modified Eagle's medium (DMEM, with 4.5 g/L glucose and L-glutamine without sodium pyruvate (Cellgro® #10-017-CV)) supplemented with 1% penicillin/streptomycin/amphotericin antibiotic-antimycotic solution (Mediatech, Inc., Herndon, Va.), 3.5 µL/L β-mercaptoethanol (Sigma #M3148-25 ml) and 10% fetal bovine serum (FBS, Mediatech, Inc., Herndon, Va.). The cells were maintained at 37° C. in a humidified incubator supplied with 5% $CO_2$.

For infection, the MEF cells were grown in 12-well plates (plated at $1.5 \times 10^5$ cells per well) in DMEM culture medium containing 10% FBS and were infected (at 80-90% confluency) with vaccinia virus WR, LIVP, GLV-1h68, GLV-1h74, or LIVP clonal isolates (1.1.1, 2.1.1, 3.1.1, 4.1.1, 5.1.1, 6.1.1, 7.1.1, and 8.1.1) in DMEM culture medium containing 2% FBS at a MOI of 0.01 for 1 hr at 37° C. The inoculum was aspirated and the cell monolayers were washed twice with 2 mL of DPBS (Mediatech, Inc., Herndon, Va.), and subsequently 2 mL of cell culture medium was added to each well. The viral titer for each virus inoculum was confirmed in CV-1 cells on the same day of infection. Three wells of each virus were harvested at 1, 24, 48, and 72 hours post-infection (hpi). The harvested cells were subject to three cycles of freeze-thaw and sonicated three times for 1 minute at full power before titration. The virus was titrated in CV-1 cells in duplicate using standard methods.

The results are presented in Table 7 below, which sets forth the replication efficiency, expressed as the average plaque forming units per milliliter (pfu/mL), and the standard deviation. LIVP 7.1.1 replicated better than all other isolates and strains tested, with strain WR replicating only slightly less efficiently. GLV-1h68, GLV-1h74 and LIVP 2.1.1 did not replicate well in MEF cells. LIVP 4.1.1 replicated better than parent LIVP and LIVP 1.1.1, 3.1.1, 5.1.1 and 8.1.1 replicated slower than parent LIVP.

TABLE 7

Viral Growth in MEF mouse embryonic fibroblast cells

| | GLV-1h68 | | LIVP | | WR | | GLV-1h74 | |
| --- | --- | --- | --- | --- | --- | --- | --- | --- |
| hpi | Average | Std Dev | Average | Std Dev | Average | Std Dev | Average | Std Dev |
| 0 | 1.16E+04 | 0.00E+00 | 2.18E+04 | 0.00E+00 | 1.08E+04 | 0.00E+00 | 2.18E+04 | 0.00E+00 |
| 1 | 3.86E+01 | 3.86E+01 | 7.72E+01 | 3.86E+01 | 6.43E+01 | 2.23E+01 | 0.00E+00 | 0.00E+00 |
| 24 | 0.00E+00 | 0.00E+00 | 1.16E+02 | 1.68E+02 | 1.54E+03 | 7.39E+02 | 1.29E+01 | 2.23E+01 |
| 48 | 0.00E+00 | 0.00E+00 | 1.43E+03 | 1.37E+03 | 9.05E+04 | 1.34E+04 | 1.29E+01 | 2.23E+01 |
| 72 | 0.00E+00 | 0.00E+00 | 2.16E+03 | 2.35E+03 | 6.67E+05 | 6.32E+04 | 0.00E+00 | 0.00E+00 |

TABLE 7-continued

| | Viral Growth in MEF mouse embryonic fibroblast cells | | | | | | | |
|---|---|---|---|---|---|---|---|---|
| | LIVP 1.1.1 | | LIVP 2.1.1 | | LIVP 3.1.1 | | LIVP 4.1.1 | |
| hpi | Average | Std Dev | Average | Std Dev | Average | Std Dev | Average | Std Dev |
| 0 | 1.81E+04 | 0.00E+00 | 1.19E+04 | 0.00E+00 | 1.88E+04 | 0.00E+00 | 1.92E+04 | 0.00E+00 |
| 1 | 5.14E+01 | 4.45E+01 | 1.29E+01 | 2.23E+01 | 9.00E+01 | 4.45E+01 | 9.00E+01 | 1.24E+02 |
| 24 | 6.43E+01 | 8.03E+01 | 0.00E+00 | 0.00E+00 | 9.00E+01 | 9.71E+01 | 3.60E+02 | 1.82E+02 |
| 48 | 7.72E+01 | 3.86E+01 | 0.00E+00 | 0.00E+00 | 2.19E+02 | 1.56E+02 | 3.65E+03 | 1.31E+03 |
| 72 | 1.29E+01 | 2.23E+01 | 0.00E+00 | 0.00E+00 | 7.97E+02 | 4.57E+02 | 3.61E+04 | 1.16E+04 |
| | LIVP 5.1.1 | | LIVP 6.1.1 | | LIVP 7.1.1 | | LIVP 8.1.1 | |
| hpi | Average | Std Dev | Average | Std Dev | Average | Std Dev | Average | Std Dev |
| 0 | 1.51E+04 | 0.00E+00 | 1.31E+04 | 0.00E+00 | 2.78E+04 | 0.00E+00 | 1.88E+04 | 0.00E+00 |
| 1 | 5.14E+01 | 2.23E+01 | 5.14E+01 | 5.89E+01 | 1.16E+02 | 3.86E+01 | 1.16E+02 | 3.86E+01 |
| 24 | 1.29E+01 | 2.23E+01 | 1.29E+01 | 2.23E+01 | 2.74E+03 | 1.57E+03 | 5.14E+01 | 4.45E+01 |
| 48 | 5.14E+01 | 5.89E+01 | 0.00E+00 | 0.00E+00 | 2.49E+05 | 7.66E+04 | 2.57E+01 | 2.23E+01 |
| 72 | 1.54E+02 | 1.54E+02 | 0.00E+00 | 0.00E+00 | 1.05E+06 | 1.63E+05 | 2.57E+01 | 4.45E+01 |

B. Cancer Cell Lines

1. B16-F10 Mouse Melanoma Cells

Mouse melanoma B16-F10 cells (ATCC® No. CRL-6475™; American Type Culture Collection (Manassas, Va.)) were grown in Dulbecco's modified Eagle's medium (DMEM, Mediatech, Inc., Herndon, Va.) supplemented with 1% antibiotic-antimycotic solution (Mediatech, Inc., Herndon, Va.) and 10% fetal bovine serum (FBS, Mediatech, Inc., Herndon, Va.). The cells were maintained at 37° C. in a humidified incubator supplied with 5% $CO_2$.

For infection, the B16-F10 cells were grown in 6-well plates (in DMEM supplemented with 2% FBS) and infected with vaccinia virus WR, LIVP, GLV-1h68, GLV-1h74, or LIVP clonal isolates (1.1.1, 2.1.1, 3.1.1, 4.1.1, 5.1.1, 6.1.1, 7.1.1, and 8.1.1) at a MOI of 0.01 for 1 hr at 37° C. The inoculum was aspirated and the cell monolayers were washed twice with 2 mL of DPBS (Mediatech, Inc., Herndon, Va.), and subsequently 2 mL of cell culture medium was added to each well. The viral titer for each virus inoculum was confirmed in CV-1 cells on the same day of infection. Three wells of each virus were harvested at 24, 48, and 72 hours post-infection (hpi). The harvested cells were subjected to three cycles of freeze-thaw and sonicated three times for 1 minute at full power before titration. The virus was titrated in CV-1 cells in duplicate using standard methods.

The results are presented in Table 8 below, which sets forth the replication efficiency, expressed as plaque forming units per milliliter (pfu/mL), and the standard deviation. GLV-1h68 replicated only minimally in B16-F10 cells. GLV-1h74 replicated significantly better ($P<0.05$) than GLV-1h68 at all time points examined, indicating the heterologous gene inserts in GLV-1h68 slowed down replication of this virus in these cells. LIVP isolates 2.1.1, 3.1.1, 6.1.1, 7.1.1 and 8.1.1 were similar to or slightly slower than GLV-1h74 in replication. LIVP 5.1.1 replicated significantly better ($P<0.01$) than GLV-1h74 at 24 and 48 hpi. LIVP 1.1.1 and the parental virus LIVP replicated similarly, but significantly better ($P<0.05$) than LIVP 5.1.1 at 24 and 48 hpi. LIVP 4.1.1 was similar to the parental virus LIVP in replication at 24 hpi, but better than LIVP at 48 ($P=0.057$) and 72 ($P=0.003$) hpi. Vaccinia virus WR replicated better than all other viruses tested. The differences in replication capacity in B16-F10 cells among LIVP isolates indicated genetic diversity in the parent LIVP virus population.

TABLE 8

| | Viral Growth in B16-F10 mouse melanoma cells | | | | | | | |
|---|---|---|---|---|---|---|---|---|
| | GLV-1h68 | | LIVP | | WR | | GLV-1h74 | |
| hpi | Average | Std Dev | Average | Std Dev | Average | Std Dev | Average | Std Dev |
| 0 | 9.76E+03 | 0.00E+00 | 2.09E+04 | 0.00E+00 | 6.04E+03 | 0.00E+00 | 1.77E+04 | 0.00E+00 |
| 24 | 1.02E+03 | 4.26E+02 | 1.51E+05 | 5.58E+03 | 8.27E+05 | 8.87E+04 | 3.87E+04 | 1.18E+04 |
| 48 | 2.73E+03 | 1.17E+03 | 1.24E+06 | 1.87E+05 | 2.76E+07 | 6.19E+06 | 2.64E+05 | 1.07E+05 |
| 72 | 2.39E+03 | 5.45E+02 | 1.11E+06 | 2.40E+05 | 1.85E+07 | 1.04E+07 | 2.36E+05 | 4.83E+04 |
| | LIVP 1.1.1 | | LIVP 2.1.1 | | LIVP 3.1.1 | | LIVP 4.1.1 | |
| hpi | Average | Std Dev | Average | Std Dev | Average | Std Dev | Average | Std Dev |
| 0 | 1.37E+04 | 0.00E+00 | 2.00E+04 | 0.00E+00 | 1.53E+04 | 0.00E+00 | 2.51E+04 | 0.00E+00 |
| 24 | 1.09E+05 | 2.24E+04 | 1.16E+04 | 4.97E+03 | 1.60E+04 | 3.87E+03 | 1.30E+05 | 2.80E+04 |
| 48 | 1.50E+06 | 1.93E+04 | 1.25E+05 | 2.64E+04 | 1.34E+05 | 1.31E+04 | 3.19E+06 | 1.26E+06 |
| 72 | 1.50E+06 | 3.23E+05 | 1.42E+05 | 2.93E+04 | 1.23E+05 | 2.66E+04 | 3.22E+06 | 5.37E+05 |

TABLE 8-continued

| | Viral Growth in B16-F10 mouse melanoma cells | | | | | | | |
|---|---|---|---|---|---|---|---|---|
| | LIVP 5.1.1 | | LIVP 6.1.1 | | LIVP 7.1.1 | | LIVP 8.1.1 | |
| hpi | Average | Std Dev | Average | Std Dev | Average | Std Dev | Average | Std Dev |
| 0 | 1.84E+04 | 0.00E+00 | 8.36E+03 | 0.00E+00 | 3.04E+04 | 0.00E+00 | 2.07E+04 | 0.00E+00 |
| 24 | 7.31E+04 | 4.29E+03 | 1.53E+04 | 3.80E+03 | 2.32E+04 | 1.02E+04 | 1.78E+04 | 4.67E+03 |
| 48 | 7.47E+05 | 4.77E+04 | 1.28E+05 | 2.16E+05 | 1.30E+05 | 9.67E+03 | 3.81E+05 | 1.53E+05 |
| 72 | 7.65E+05 | 3.31E+05 | 2.21E+05 | 1.67E+05 | 2.20E+05 | 5.50E+04 | 3.25E+05 | 8.26E+04 |

2. DU 145 Human Prostate Carcinoma Cells

Human prostate carcinoma DU 145 cells (ATCC® No. HTB-81™; American Type Culture Collection (Manassas, Va.)) were grown in EMEM (Mediatech, Inc., Herndon, Va.) containing 1% sodium pyruvate (Mediatech, Inc., Herndon, Va.), 1% antibiotic-antimycotic solution (Mediatech, Inc., Herndon, Va.), 1% nonessential amino acids (Mediatech, Inc., Herndon, Va.), and 10% FBS. The cells were maintained at 37° C. in a humidified incubator supplied with 5% $CO_2$.

For infection, the DU145 cells were grown in 6-well plates (DMEM supplemented with 2% FBS) and were infected with vaccinia virus WR, LIVP, GLV-1h68, GLV-1h74, or LIVP clonal isolates (1.1.1, 2.1.1, 3.1.1, 4.1.1, 5.1.1, 6.1.1, 7.1.1, and 8.1.1) at a MOI of 0.01 for 1 hr at 37° C. The inoculum was aspirated and the cell monolayers were washed twice with 2 mL of DPBS (Mediatech, Inc., Herndon, Va.), and subsequently 2 mL of cell culture medium was added to each well. The viral titer for each virus inoculum was confirmed in CV-1 cells on the same day of infection. Three wells of each virus were harvested at 24, 48, and 72 hours post-infection (hpi). The harvested cells were subject to three cycles of freeze-thaw and sonicated three times for 1 minute at full power before titration. The virus was titrated in CV-1 cells in duplicate using standard methods.

The results are presented in Table 9 below, which sets forth the replication efficiency, expressed as plaque forming units per milliliter (pfu/mL), and the standard deviation. GLV-1h68 replicated reasonably well in DU 145 cells. GLV-1h74 replicated significantly better (P<0.01) than GLV-1h68 at all time points examined, indicating the foreign inserts of GLV-1h68 slowed down replication of this virus in the DU 145 cells. The wild-type vaccinia virus WR was similar to GLV-1h68 in replication in DU 145 cells. LIVP 3.1.1 and GLV-1h74 replicated similarly in the first 24 hours post infection. The viral yields of GLV-1h74 at 48 and 72 hpi were significantly higher (P<0.01) then that of LIVP 3.1.1. LIVP and the LIVP isolates 1.1.1, 2.1.1, 4.1.1, 5.1.1, 6.1.1, 7.1.1, and 8.1.1 replicated similarly, but significantly better (P<0.01) than GLV-1h74 in the first 24 hours post infection.

TABLE 9

| | Viral Growth in DU 145 human prostate carcinoma cells | | | | | | | |
|---|---|---|---|---|---|---|---|---|
| | GLV-1h68 | | LIVP | | WR | | GLV-1h74 | |
| hpi | Average | Std Dev | Average | Std Dev | Average | Std Dev | Average | Std Dev |
| 0 | 6.75E+03 | 0.00E+00 | 1.35E+04 | 0.00E+00 | 1.04E+04 | 0.00E+00 | 1.04E+04 | 0.00E+00 |
| 24 | 1.16E+06 | 7.17E+04 | 4.17E+07 | 3.54E+06 | 2.08E+06 | 2.04E+05 | 9.62E+06 | 7.61E+05 |
| 48 | 4.30E+07 | 5.02E+06 | 1.85E+08 | 2.04E+07 | 2.21E+07 | 4.71E+06 | 1.90E+08 | 8.91E+06 |
| 72 | 5.12E+07 | 1.61E+06 | 1.88E+08 | 5.42E+07 | 3.65E+07 | 6.92E+06 | 2.55E+08 | 7.72E+06 |
| | LIVP 1.1.1 | | LIVP 2.1.1 | | LIVP 3.1.1 | | LIVP 4.1.1 | |
| hpi | Average | Std Dev | Average | Std Dev | Average | Std Dev | Average | Std Dev |
| 0 | 1.54E+04 | 0.00E+00 | 1.93E+04 | 0.00E+00 | 1.72E+04 | 0.00E+00 | 2.24E+04 | 0.00E+00 |
| 24 | 4.32E+07 | 4.82E+06 | 2.88E+07 | 3.96E+06 | 8.77E+06 | 4.96E+05 | 4.22E+07 | 1.26E+07 |
| 48 | 2.34E+08 | 2.48E+07 | 1.14E+08 | 7.81E+06 | 5.74E+07 | 5.79E+06 | 2.03E+08 | 1.94E+07 |
| 72 | 2.62E+08 | 3.54E+07 | 9.52E+07 | 2.19E+07 | 5.09E+07 | 1.50E+07 | 2.16E+08 | 3.36E+07 |
| | LIVP 5.1.1 | | LIVP 6.1.1 | | LIVP 7.1.1 | | LIVP 8.1.1 | |
| hpi | Average | Std Dev | Average | Std Dev | Average | Std Dev | Average | Std Dev |
| 0 | 1.49E+04 | 0.00E+00 | 8.68E+03 | 0.00E+00 | 2.22E+04 | 0.00E+00 | 1.91E+04 | 0.00E+00 |
| 24 | 3.58E+07 | 5.47E+06 | 2.37E+07 | 3.21E+06 | 2.88E+07 | 6.24E+06 | 2.52E+07 | 6.47E+06 |
| 48 | 1.42E+08 | 2.48E+06 | 1.42E+08 | 9.30E+06 | 1.74E+08 | 3.12E+07 | 1.24E+08 | 5.56E+06 |
| 72 | 1.61E+08 | 5.56E+07 | 1.21E+08 | 1.82E+07 | 1.59E+08 | 7.00E+06 | 1.18E+08 | 1.18E+07 |

3. CT26.WT Mouse Colon Carcinoma Cells

Mouse CT26.WT colon carcinoma cells (ATCC® CRL-2638™; American Type Culture Collection (Manassas, Va.)) were grown in RPMI containing 1% sodium pyruvate (Mediatech, Inc., Herndon, Va.), 1% streptomycin/amphotericin antibiotic/antimycotic solution (Mediatech, Inc., Herndon, Va.), 1% HEPES (Mediatech, Inc., Herndon, Va.), 5.6 mL/L 45% Glucose solution (Mediatech, Inc., Herndon, Va.), and 10% FBS. The cells were maintained at 37° C. in a humidified incubator supplied with 5% $CO_2$.

For infection, the CT26.WT cells were grown in 6-well plates (plated at $5 \times 10^5$ cells per well) in RPMI culture medium containing 10% FBS and were infected (at 80-90% confluency) with vaccinia virus WR, LIVP, GLV-1h68, GLV-1h74, or LIVP clonal isolates (1.1.1, 2.1.1, 3.1.1, 4.1.1, 5.1.1, 6.1.1, 7.1.1, and 8.1.1) in RPMI culture medium containing 2% FBS at a MOI of 0.01 for 1 hr at 37° C. with swirling every 20 minutes. The inoculum was aspirated and the cell monolayers were washed twice with 2 mL of DPBS (Mediatech, Inc., Herndon, Va.), and subsequently 2 mL of cell culture medium was added to each well. The viral titer for each virus inoculum was confirmed in CV-1 cells on the same day of infection. Three wells of each virus were harvested at 1, 24, 48, and 72 hours post-infection (hpi). The harvested cells were subject to three cycles of freeze-thaw and sonicated three times for 1 minute at full power before titration. The virus was titrated in CV-1 cells in duplicate using standard methods.

The results are presented in Table 10 below, which sets forth the replication efficiency, expressed as the average plaque forming units per milliliter (pfu/mL), and the standard deviation. GLV-1h68 replicated only minimally in CT26.WT cells. GLV-1h74 replicated better than GLV-1h68 at all time points examined. Vaccinia virus WR replicated better than all other viruses tested. LIVP 1.1.1, LIVP 5.1.1, LIVP 4.1.1 and the parental virus LIVP replicated similarly, each replicating better than GLV-1h74. LIVP isolates 2.1.1, 6.1.1 and 7.1.1 were similar to or slightly slower than GLV-1h74 in replication.

4. MC-38 Mouse Adenocarcinoma Cells

Mouse MC-38 adenocarcinoma cells (Jochen Stritzker, University of Wuerzburg) were grown in were grown in RPMI containing 1% sodium pyruvate (Mediatech, Inc., Herndon, Va.), 1% streptomycin/amphotericin antibiotic-antimycotic solution (Mediatech, Inc., Herndon, Va.), 1% HEPES (Mediatech, Inc., Herndon, Va.), 5.6 mL/L 45% Glucose solution (Mediatech, Inc., Herndon, Va.), and 10% FBS. The cells were maintained at 37° C. in a humidified incubator supplied with 5% $CO_2$.

For infection, the MC-38 cells were grown in 6-well plates (plated at $5 \times 10^5$ cells per well) in RPMI culture medium containing 10% FBS and were infected (at 80-90% confluency) with vaccinia virus WR, LIVP, GLV-1h68, GLV-1h74, or LIVP clonal isolates (1.1.1, 2.1.1, 3.1.1, 4.1.1, 5.1.1, 6.1.1, 7.1.1, and 8.1.1) in RPMI culture medium containing 2% FBS at a MOI of 0.01 for 1 hr at 37° C. The inoculum was aspirated and the cell monolayers were washed twice with 2 mL of DPBS (Mediatech, Inc., Herndon, Va.), and subsequently 2 mL of cell culture medium was added to each well. The viral titer for each virus inoculum was confirmed in CV-1 cells on the same day of infection. Three wells of each virus were harvested at 1, 24, 48, and 72 hours post-infection (hpi). The harvested cells were subject to three cycles of freeze-thaw and sonicated three times for 1 minute at full power before titration. The virus was titrated in CV-1 cells in duplicate using standard methods.

The results are presented in Table 11 below, which sets forth the replication efficiency, expressed as the average plaque forming units per milliliter (pfu/mL), and the standard deviation. GLV-1h68 replicated only minimally in MC-38 cells. LIVP 5.1.1 replicated the best at the 1, 24 and 48 hour time points, with only WR replicating better at the 72 hour time point. LIVP replicated slightly better than GV-1h74. LIVP isolates 2.1.1, 6.1.1 and 8.1.1 were similar to or slightly slower than GLV-1h74 in replication.

TABLE 10

Viral Growth in CT26.WT mouse colon carcinoma cells

| | GLV-1h68 | | LIVP | | WR | | GLV-1h74 | |
|---|---|---|---|---|---|---|---|---|
| hpi | Average | Std Dev | Average | Std Dev | Average | Std Dev | Average | Std Dev |
| 0 | 1.20E+04 | 0.00E+00 | 1.77E+04 | 0.00E+00 | 1.10E+04 | 0.00E+00 | 1.56E+04 | 0.00E+00 |
| 1 | 3.07E+02 | 7.60E+01 | 1.72E+03 | 1.83E+02 | 5.56E+02 | 1.32E+02 | 7.60E+02 | 2.21E+02 |
| 24 | 2.41E+02 | 1.16E+02 | 8.99E+04 | 3.05E+04 | 2.55E+05 | 4.39E+04 | 2.25E+04 | 3.07E+03 |
| 48 | 2.19E+02 | 1.22E+02 | 1.55E+05 | 1.59E+04 | 1.09E+06 | 1.77E+05 | 3.22E+04 | 2.87E+03 |
| 72 | 3.87E+02 | 4.57E+01 | 1.64E+05 | 2.99E+04 | 1.35E+06 | 5.23E+05 | 4.39E+04 | 8.14E+03 |

| | LIVP 1.1.1 | | LIVP 2.1.1 | | LIVP 3.1.1 | | LIVP 4.1.1 | |
|---|---|---|---|---|---|---|---|---|
| hpi | Average | Std Dev | Average | Std Dev | Average | Std Dev | Average | Std Dev |
| 0 | 2.02E+04 | 0.00E+00 | 1.16E+04 | 0.00E+00 | 1.55E+04 | 0.00E+00 | 1.70E+04 | 0.00E+00 |
| 1 | 1.74E+03 | 2.96E+02 | 4.90E+02 | 2.04E+02 | 1.35E+03 | 1.67E+02 | 1.93E+03 | 1.52E+02 |
| 24 | 5.07E+04 | 2.90E+03 | 4.69E+03 | 5.16E+02 | 3.25E+04 | 3.35E+02 | 7.89E+04 | 1.54E+04 |
| 48 | 1.82E+05 | 7.60E+03 | 1.07E+04 | 1.44E+03 | 7.58E+04 | 1.99E+04 | 1.35E+05 | 2.37E+04 |
| 72 | 1.78E+05 | 1.04E+04 | 1.18E+04 | 2.74E+03 | 8.55E+04 | 1.16E+04 | 1.26E+05 | 2.28E+04 |

| | LIVP 5.1.1 | | LIVP 6.1.1 | | LIVP 7.1.1 | | LIVP 8.1.1 | |
|---|---|---|---|---|---|---|---|---|
| hpi | Average | Std Dev | Average | Std Dev | Average | Std Dev | Average | Std Dev |
| 0 | 1.35E+04 | 0.00E+00 | 1.20E+04 | 0.00E+00 | 1.94E+04 | 0.00E+00 | 1.86E+04 | 0.00E+00 |
| 1 | 1.14E+03 | 1.95E+02 | 7.02E+02 | 1.75E+02 | 1.08E+03 | 1.59E+02 | 9.58E+02 | 1.43E+02 |
| 24 | 4.21E+04 | 1.44E+04 | 7.27E+03 | 1.47E+03 | 8.04E+03 | 8.86E+02 | 1.20E+04 | 1.21E+03 |
| 48 | 2.27E+05 | 4.30E+04 | 2.65E+04 | 5.31E+03 | 4.82E+04 | 9.34E+03 | 6.18E+04 | 6.58E+03 |
| 72 | 2.76E+05 | 4.61E+04 | 2.74E+04 | 5.89E+03 | 4.80E+04 | 7.93E+03 | 9.43E+04 | 1.80E+04 |

TABLE 11

Viral Growth in MC-38 mouse adenocarcinoma cells

| | GLV-1h68 | | LIVP | | WR | | GLV-1h74 | |
|---|---|---|---|---|---|---|---|---|
| hpi | Average | Std Dev | Average | Std Dev | Average | Std Dev | Average | Std Dev |
| 0 | 9.20E+03 | 0.00E+00 | 1.40E+04 | 0.00E+00 | 8.52E+03 | 0.00E+00 | 1.39E+04 | 0.00E+00 |
| 1 | 6.06E+02 | 1.84E+02 | 3.42E+03 | 3.67E+02 | 1.00E+02 | 1.20E+02 | 1.14E+03 | 2.08E+02 |
| 24 | 2.12E+02 | 1.14E+02 | 2.89E+04 | 1.01E+04 | 2.38E+04 | 6.94E+02 | 7.64E+03 | 9.55E+02 |
| 48 | 1.06E+02 | 2.62E+01 | 6.36E+04 | 3.72E+03 | 7.95E+04 | 1.50E+04 | 4.39E+04 | 3.92E+03 |
| 72 | 1.67E+02 | 1.05E+02 | 6.89E+04 | 1.16E+04 | 2.71E+05 | 9.46E+03 | 5.20E+04 | 1.41E+04 |

| | LIVP 1.1.1 | | LIVP 2.1.1 | | LIVP 3.1.1 | | LIVP 4.1.1 | |
|---|---|---|---|---|---|---|---|---|
| hpi | Average | Std Dev | Average | Std Dev | Average | Std Dev | Average | Std Dev |
| 0 | 1.25E+04 | 0.00E+00 | 8.86E+03 | 0.00E+00 | 1.47E+04 | 0.00E+00 | 1.60E+04 | 0.00E+00 |
| 1 | 2.53E+03 | 1.72E+02 | 1.03E+03 | 3.65E+02 | 2.47E+03 | 5.55E+02 | 3.61E+03 | 2.78E+02 |
| 24 | 2.02E+04 | 2.50E+03 | 2.08E+03 | 6.81E+02 | 1.38E+04 | 2.62E+03 | 3.55E+04 | 1.98E+03 |
| 48 | 6.42E+04 | 6.17E+03 | 5.58E+03 | 4.55E+02 | 4.02E+04 | 1.60E+03 | 8.65E+04 | 2.83E+04 |
| 72 | 6.27E+04 | 1.99E+04 | 7.08E+03 | 7.08E+02 | 4.65E+04 | 7.39E+03 | 8.45E+04 | 7.22E+03 |

| | LIVP 5.1.1 | | LIVP 6.1.1 | | LIVP 7.1.1 | | LIVP 8.1.1 | |
|---|---|---|---|---|---|---|---|---|
| hpi | Average | Std Dev | Average | Std Dev | Average | Std Dev | Average | Std Dev |
| 0 | 1.40E+04 | 0.00E+00 | 1.26E+04 | 0.00E+00 | 1.56E+04 | 0.00E+00 | 1.50E+04 | 0.00E+00 |
| 1 | 3.41E+03 | 8.67E+02 | 1.74E+03 | 3.67E+02 | 2.52E+03 | 5.27E+02 | 2.18E+03 | 5.12E+02 |
| 24 | 4.05E+04 | 4.75E+03 | 7.21E+03 | 1.14E+02 | 1.59E+04 | 1.20E+03 | 7.33E+03 | 3.53E+02 |
| 48 | 1.85E+05 | 6.88E+04 | 1.83E+04 | 3.92E+03 | 5.41E+04 | 1.03E+04 | 2.26E+04 | 7.31E+03 |
| 72 | 1.71E+05 | 6.60E+04 | 1.73E+04 | 5.00E+03 | 5.00E+04 | 4.38E+03 | 2.94E+04 | 4.64E+03 |

Example 3

Construction of Viruses Encoding an Anti-VEGF Single-Chain Antibody

1. GLV-1h164

In this example, GLV-1h164, containing a gene (GLAF-2) including the single chain anti-VEGF antibody gene (G6; SEQ ID NO:73) inserted at the A56R locus under control of the VACV synthetic late promotor was generated from GLV-1h100 by double reciprocal crossover. GLV-1h100 was derived from GLV-1h68 by replacing the β-galactosidase expression cassette at the J2R locus with an hNET expression cassette through in vivo homologous recombination (see U.S. Pat. No. 7,588,767 and U.S. Pat. Pub. No. 2009-0117034).

TABLE 12

Generation of GLV-1h164

| Name of Virus | Parental Virus | VV Transfer Vector | Genotype |
|---|---|---|---|
| GLV-1h68 | — | — | F14.5L: ($P_{SEL}$)Ruc-GFP TK: ($P_{SEL}$)rTrfR-($P_{7.5k}$)LacZ HA: ($P_{11k}$)gusA |
| GLV-1h100 | GLV-1h68 | TK-SE-hNET3 | F14.5L: ($P_{SEL}$)Ruc-GFP TK: ($P_{SE}$)hNET HA: ($P_{11k}$)gusA |
| GLV-1h164 | GLV-1h100 | pHA-$P_{SL}$-GLAF-2 | F14.5L: ($P_{SEL}$)Ruc-GFP TK: ($P_{SE}$)hNET HA: ($P_{SL}$)GLAF-2 |

Plasmid 0608997-pGA4, containing DNA coding for the single chain anti-VEGF antibody GLAF-1 (SEQ ID NO:12 and 21), containing a Ig kappa light chain leader sequence, the $V_H$ chain sequence of the G6 Fab, a $(G_4S)_3$ linker sequence, the $V_L$ chain sequence of the G6 Fab and a C terminal DDDDK sequence (SEQ ID NO:18), was synthesized by GeneArt AG (Germany). Using this vector as a template, PCR was performed with the primers P-G6-for-b (5'-gtcgacccaccatggagac-3', SEQ ID NO:19) and P-G6-rev-b (5'-ttaattaattatcgcttaatctcaaccttggtccc-3', SEQ ID NO:20) to amplify a version of the gene sequence of GLAF-1 (SEQ ID NO:12 and 21) without the DDDDK sequence (GLAF-2, SEQ ID NO:22). To construct the final plasmid, the VACV DNA homology-based shuttle plasmid pHA-$P_{SL}$-hNET-1 (SEQ ID NO:23) was used which was previously constructed for homologous recombination of foreign genes into the A56R locus in the VACV genome through double reciprocal crossover. The GLAF-2 fragment was cloned into the framework plasmid via the SalI and PacI sites, thereby replacing the hNet-1 cDNA sequence with the GLAF-2 cDNA, resulting in the plasmid pHA-$P_{SL}$-GLAF-2.

African green monkey kidney fibroblast CV-1 cells (American Type Culture Collection (Manassas, Va.); CCL-70™) were employed for viral generation and production. The cells were grown in Dulbecco's modified Eagle's medium (DMEM) supplemented with 1% antibiotic-antimycotic solution (Mediatech, Inc., Herndon, Va.) and 10% fetal bovine serum (FBS; Mediatech, Inc., Herndon, Va.) at 37° C. under 5% $CO_2$. The CV-1 cells were infected with GLV-1h164 at MOI. of 0.1 for 1 hr. The infected cells were then transfected using Fugene (Roche, Indianapolis, Ind.) with the pHA-PSL-GLAF-2 transfer vector. At two days post infection, infected/transfected cells were harvested and the recombinant viruses were selected and plaque purified using standard methods as described previously (Falkner and Moss (1990) J. Virol. 64:3108-3111).

Ten T225 flasks of confluent CV-1 cells (seeded at $2 \times 10^7$ cells per flask the day before infection) were infected with each virus at MOI of 0.1. The infected cells were harvested two days post infection and lysed using a glass Dounce homogenizer. The cell lysate was clarified by centrifugation at 1,800g for 5 min, and then layered on a cushion of 36% sucrose, and centrifuged at 13,000 rpm in a HB-6 rotor, Sorvall™ RC-5B Refrigerated Superspeed Centrifuge for 2 hours. The virus pellet was resuspended in 1 ml of 1 mM Tris, pH 9.0, loaded on a sterile 24% to 40% continuous sucrose gradient, and centrifuged at 26,000g for 50 min. The virus band was collected and diluted using 2 volumes of 1 mM Tris, pH 9.0, and then centrifuged at 13,000 rpm in a HB-6 rotor for 60 min. The final virus pellet was resuspended in 1 ml of 1 mM Tris, pH 9.0 and the titer was determined in CV-1 cells (ATCC® No. CCL-70™).

2. GLV-1h109

The generation of GLV-1h109 is described in U.S. Pat. No. 8,052,968. GLN-1h109 was derived from the GLV-1 h68strain (SEQ ID NO:9) by replacement of LacZ gene (beta-galactosidase) by the gene encoding GLAF-1 (SEQ ID NO:12 and 21) into the A56R locus. The GLAF-1 gene, which encodes an anti-VEGF single-chain antibody G6, is under the control of the VACV synthetic late (SL) promoter.

3. GLV-1h158

GLV-1h158 was derived from the GLV-1h68 strain (SEQ ID NO:9) by replacement of gusA gene (beta-glucuronidase) by the gene encoding GLAF-2 (SEQ ID NO:22) into J2R locus. The GLAF-2 gene, which encodes an anti-VEGFR single chain antibody G6, is under the control of the VACV synthetic early/late (SEL) promoter.

4. GLV-1h163

GLV-1h163 was derived from the GLV-1h100 strain (described in Example 3.1 above) by replacement of gusA gene (beta-glucuronidase) by the gene encoding GLAF-2 (SEQ ID NO:22) into A56R locus. The GLAF-2 gene is under the control of the VACV synthetic early/late (SEL) promoter. In addition, GLV-1h163 carries the human norepinephrine transporter (NET) under the control of the VACV synthetic early (SE) promoter into J2R locus.

Example 4

In Vitro Virus Replication Studies with LIVP Isolate 1.1.1

In this example, in vitro virus replication of LIVP isolate 1.1.1 in several cancer cell lines was examined and compared to that of vaccinia viruses GLV-1h68 (described in Example 1 and U.S. Pat. No. 7,588,767) and GLV-1h164 (described in Example 3 above). In addition, each virus was evaluated after pre-treatment with irradiation, as described below.

1. B16-F10 Mouse Melanoma Cells

Mouse melanoma B16-F10 cells (ATCC® No. CRL-6475™; American Type Culture Collection (Manassas, Va.)) were grown in DMEM medium and were infected with vaccinia viruses GLV-1h68, GLV-1h164 or LIVP clonal isolate 1.1.1 at a MOI of 0.01 for 24, 48 or 72 hours at 37° C.

Radiation Treatment

The cells were irradiated at a dosage of 6 Gy one day before virus infection or received no radiation. Irradiation was administered as a single fraction using a RS2000 X-ray biological irradiator (Rad Source Technologies Inc.). The dose rate of radiation was 1 Gy/minute.

The virus was titrated in CV-1 cells in duplicate using standard methods. The results are presented in Table 13 below, which sets forth the replication efficiency, expressed as the average plaque forming units per milliliter (pfu/mL), and the standard deviation. As shown in the Table, LIVP 1.1.1 exhibited significantly enhanced viral replication in B16-F10 cells compared to GLV-1h68 and GLV-1h164.

TABLE 13

Viral growth in B16-F10 mouse melanoma cells

| | GLV-1h68 | | GLV-1h164 | | LIVP 1.1.1 | |
|---|---|---|---|---|---|---|
| hpi | Average | Std Dev | Average | Std Dev | Average | Std Dev |
| 0 | 2.24E+03 | 0.00E+00 | 2.24E+03 | 0.00E+00 | 2.24E+03 | 0.00E+00 |
| 24 | 5.25E+03 | 1.98E+03 | 2.67E+03 | 5.77E+02 | 4.59E+05 | 1.01E+05 |
| 48 | 2.50E+03 | 6.61E+02 | 1.42E+03 | 6.29E+02 | 7.08E+05 | 1.46E+05 |
| 72 | 2.50E+02 | 0.00E+00 | 1.33E+02 | 2.89E+01 | 6.67E+04 | 2.89E+04 |

| | GLV-1h68 + XRT | | GLV-1h164 + XRT | | LIVP 1.1.1 + XRT | |
|---|---|---|---|---|---|---|
| hpi | Average | Std Dev | Average | Std Dev | Average | Std Dev |
| 0 | 2.24E+03 | 0.00E+00 | 2.24E+03 | 0.00E+00 | 2.24E+03 | 0.00E+00 |
| 24 | 3.00E+03 | 1.39E+03 | 2.75E+03 | 9.01E+02 | 1.25E+05 | 8.66E+04 |
| 48 | 6.25E+02 | 3.70E+02 | 3.67E+02 | 1.76E+02 | 2.08E+05 | 8.04E+04 |
| 72 | 8.33E+01 | 3.82E+01 | 1.00E+02 | 4.33E+01 | 5.33E+04 | 1.18E+04 |

2. A549 Human Lung Carcinoma Cells

Human A549 lung carcinoma cells (ATCC®) were grown in F-12K Medium and were infected with vaccinia viruses GLV-1h68, GLV-1h164, or LIVP isolate 1.1.1 at a MOI of 0.01 for 24, 48 or 72 hours at 37° C. The cells were irradiated with 6 Gy gamma radiation or received no radiation treatment as described above. The virus was titrated in CV-1 cells in duplicate using standard methods.

The results are presented in Table 14 below, which sets forth the replication efficiency, expressed as the average plaque forming units per milliliter (pfu/mL), and the standard deviation. As shown in the Table, LIVP 1.1.1 exhibited enhanced viral replication in A549 cells compared to GLV-1h68 and GLV-1h164.

TABLE 14

Viral Growth in A549 human lung carcinoma cells

| | GLV-1h68 | | GLV-1h164 | | LIVP 1.1.1 | |
|---|---|---|---|---|---|---|
| hpi | Average | Std Dev | Average | Std Dev | Average | Std Dev |
| 0 | 2.10E+03 | 0.00E+00 | 2.10E+03 | 0.00E+00 | 2.10E+03 | 0.00E+00 |
| 24 | 3.50E+05 | 1.09E+05 | 5.58E+05 | 1.28E+05 | 1.28E+07 | 4.51E+06 |
| 48 | 1.06E+07 | 4.11E+06 | 1.57E+07 | 7.75E+06 | 1.40E+08 | 4.33E+06 |
| 72 | 1.33E+07 | 1.01E+07 | 2.42E+07 | 1.76E+07 | 7.75E+07 | 5.02E+07 |

| | GLV-1h68 + XRT | | GLV-1h164 + XRT | | LIVP 1.1.1 + XRT | |
|---|---|---|---|---|---|---|
| hpi | Average | Std Dev | Average | Std Dev | Average | Std Dev |
| 0 | 2.10E+03 | 0.00E+00 | 2.10E+03 | 0.00E+00 | 2.10E+03 | 0.00E+00 |
| 24 | 2.08E+05 | 1.13E+05 | 1.92E+05 | 3.82E+04 | 5.58E+06 | 1.15E+06 |
| 48 | 5.08E+06 | 1.04E+06 | 7.33E+06 | 2.04E+06 | 3.08E+07 | 6.29E+06 |
| 72 | 2.92E+07 | 1.26E+07 | 2.17E+07 | 1.77E+07 | 4.92E+07 | 2.32E+07 |

3. MDA-MB-231 Human Breast Carcinoma Cells

Human MDA-MB-231 breast carcinoma cells (ATCC®) were grown in Leibovitz's L-15 Medium and were infected with vaccinia viruses GLV-1h68, GLV-1h164, or LIVP isolate 1.1.1 at a MOI of 0.01 for 24, 48 or 72 hours at 37° C. The cells were irradiated with 6 Gy gamma radiation or received no radiation treatment as described above. The virus was titrated in CV-1 cells in duplicate using standard methods.

The results are presented in Table 15 below, which sets forth the replication efficiency, expressed as the average plaque forming units per milliliter (pfu/mL), and the standard deviation. As shown in the Table, LIVP 1.1.1 exhibited significantly enhanced viral replication in MDA-MB-231 cells compared to GLV-1h68 and GLV-1h164.

TABLE 15

Viral Growth in MDA-MB-231 human breast carcinoma cells

| | GLV-1h68 | | GLV-1h164 | | LIVP 1.1.1 | |
|---|---|---|---|---|---|---|
| hpi | Average | Std Dev | Average | Std Dev | Average | Std Dev |
| 0 | 1.94E+03 | 0.00E+00 | 1.94E+03 | 0.00E+00 | 1.94E+03 | 0.00E+00 |
| 24 | 6.42E+03 | 1.26E+03 | 8.00E+03 | 1.64E+03 | 3.67E+05 | 9.46E+04 |
| 48 | 1.22E+05 | 4.50E+04 | 1.07E+05 | 3.09E+04 | 8.08E+06 | 6.87E+06 |
| 72 | 4.08E+05 | 2.98E+05 | 6.33E+05 | 7.22E+04 | 3.33E+06 | 1.13E+06 |

| | GLV-1h68 + XRT | | GLV-1h164 + XRT | | LIVP 1.1.1 + XRT | |
|---|---|---|---|---|---|---|
| hpi | Average | Std Dev | Average | Std Dev | Average | Std Dev |
| 0 | 1.94E+03 | 0.00E+00 | 1.94E+03 | 0.00E+00 | 1.94E+03 | 0.00E+00 |
| 24 | 5.17E+03 | 1.77E+03 | 4.83E+03 | 1.46E+03 | 2.92E+05 | 3.82E+04 |
| 48 | 3.42E+04 | 2.47E+04 | 1.83E+04 | 1.38E+04 | 3.08E+06 | 7.64E+05 |
| 72 | 5.53E+04 | 1.76E+04 | 8.17E+04 | 2.89E+03 | 8.58E+06 | 2.60E+06 |

4. MIA PaCa-2 Human Pancreatic Carcinoma Cells

Human MIA PaCa-2 pancreatic carcinoma cells (ATCC®) were grown in DMEM medium and were infected with vaccinia viruses GLV-1h68, GLV-1h164, or LIVP isolate 1.1.1 at a MOI of 0.01 for 24, 48 or 72 hours at 37° C. The cells were irradiated with 6 Gy gamma radiation or received no radiation treatment as described above. The virus was titrated in CV-1 cells in duplicate using standard methods.

The results are presented in Table 16 below, which sets forth the replication efficiency, expressed as the average plaque forming units per milliliter (pfu/mL), and the standard deviation. As shown in the Table, LIVP 1.1.1 exhibited enhanced viral replication in MIA PaCa-2 cells compared to GLV-1h68 and GLV-1h164.

TABLE 16

Viral growth in MIA PaCa-2 human pancreatic carcinoma cells

| | GLV-1h68 | | GLV-1h164 | | LIVP 1.1.1 | |
|---|---|---|---|---|---|---|
| hpi | Average | Std Dev | Average | Std Dev | Average | Std Dev |
| 0 | 1.38E+03 | 0.00E+00 | 1.38E+03 | 0.00E+00 | 1.38E+03 | 0.00E+00 |
| 24 | 7.75E+04 | 2.18E+04 | 1.53E+05 | 3.68E+04 | 1.33E+06 | 1.44E+05 |
| 48 | 4.67E+06 | 1.18E+06 | 8.33E+06 | 8.78E+05 | 9.92E+07 | 1.77E+07 |
| 72 | 7.50E+06 | 4.33E+06 | 1.42E+07 | 5.20E+06 | 1.92E+08 | 2.89E+07 |

| | GLV-1h68 + XRT | | GLV-1h164 + XRT | | LIVP 1.1.1 + XRT | |
|---|---|---|---|---|---|---|
| hpi | Average | Std Dev | Average | Std Dev | Average | Std Dev |
| 0 | 1.38E+03 | 0.00E+00 | 1.38E+03 | 0.00E+00 | 1.38E+03 | 0.00E+00 |
| 24 | 3.17E+04 | 7.64E+03 | 5.17E+04 | 4.00E+04 | 1.92E+06 | 1.38E+06 |
| 48 | 8.00E+05 | 6.61E+04 | 1.25E+06 | 7.50E+04 | 3.17E+07 | 1.38E+07 |
| 72 | 7.17E+06 | 2.10E+06 | 5.00E+06 | 5.00E+05 | 5.50E+07 | 3.38E+07 |

5. PC-3 Human Prostate Cancer Cells

Human PC-3 prostate cancer cells (ATCC®) were grown in F-12K Medium and were infected with vaccinia viruses GLV-1h68, GLV-1h164, or LIVP isolate 1.1.1 at a MOI of 0.01 for 24, 48, and 72 hours at 37° C. The cells were irradiated with 6 Gy gamma radiation or received no radiation treatment as described above. The virus was titrated in CV-1 cells in duplicate using standard methods.

The results are presented in Table 17 below, which sets forth the replication efficiency, expressed as the average plaque forming units per milliliter (pfu/mL), and the standard deviation. As shown in the Table, LIVP 1.1.1 exhibited slightly enhanced viral replication in PC-3 cells compared to GLV-1h68 and GLV-1h164.

TABLE 17

Viral growth in PC-3 human prostate cancer cells

| | GLV-1h68 | | GLV-1h164 | | LIVP 1.1.1 | |
|---|---|---|---|---|---|---|
| hpi | Average | Std Dev | Average | Std Dev | Average | Std Dev |
| 0 | 1.54E+03 | 0.00E+00 | 1.54E+03 | 0.00E+00 | 1.54E+03 | 0.00E+00 |
| 24 | 1.42E+05 | 6.29E+04 | 2.92E+05 | 5.77E+04 | 5.42E+06 | 1.89E+06 |
| 48 | 5.41E+06 | 4.08E+06 | 7.83E+06 | 1.76E+06 | 8.67E+06 | 4.13E+06 |
| 72 | 7.83E+05 | 1.81E+05 | 8.33E+05 | 2.67E+05 | 3.33E+06 | 1.76E+06 |

| | GLV-1h68 + XRT | | GLV-1h164 + XRT | | LIVP 1.1.1 + XRT | |
|---|---|---|---|---|---|---|
| hpi | Average | Std Dev | Average | Std Dev | Average | Std Dev |
| 0 | 1.54E+03 | 0.00E+00 | 1.54E+03 | 0.00E+00 | 1.54E+03 | 0.00E+00 |
| 24 | 3.00E+05 | 4.33E+04 | 2.08E+05 | 1.13E+05 | 5.42E+06 | 3.82E+05 |
| 48 | 3.17E+06 | 1.51E+06 | 3.00E+06 | 5.00E+05 | 2.58E+06 | 1.53E+06 |
| 72 | 2.67E+06 | 2.24E+06 | 1.92E+06 | 7.64E+05 | 4.17E+06 | 7.64E+05 |

6. U-87 MG Human Glioblastoma-Astrocytoma Cells

Human U-87 MG glioblastoma-astrocytoma cells (ATCC®) were grown in DMEM and were infected with vaccinia viruses GLV-1h68, GLV-1h164, or LIVP isolate 1.1.1 at a MOI of 0.01 for 24 hours at 37° C. The cells were irradiated with 6 Gy gamma radiation or received no radiation treatment as described above. The virus was titrated in CV-1 cells in duplicate using standard methods.

The results are presented in Table 18 below, which sets forth the replication efficiency, expressed as the average plaque forming units per milliliter (pfu/mL), and the standard deviation. As shown in the table, LIVP 1.1.1 exhibited enhanced viral replication in U-87 cells compared to GLV-1h68 and GLV-1h164.

TABLE 18

Viral growth in U-87 human glioblastoma-astrocytoma cells

| | GLV-1h68 | | GLV-1h164 | | LIVP 1.1.1 | |
|---|---|---|---|---|---|---|
| hpi | Average | Std Dev | Average | Std Dev | Average | Std Dev |
| 0 | 1.28E+03 | 0.00E+00 | 1.28E+03 | 0.00E+00 | 1.28E+03 | 0.00E+00 |
| 24 | 6.08E+03 | 2.13E+03 | 1.23E+04 | 3.25E+03 | 4.17E+06 | 2.50E+06 |
| 48 | 4.08E+05 | 1.01E+05 | 5.83E+05 | 4.65E+05 | 3.83E+07 | 2.79E+07 |
| 72 | 5.75E+05 | 2.95E+05 | 6.67E+06 | 2.40E+06 | 6.92E+07 | 2.57E+07 |

| | GLV-1h68 + XRT | | GLV-1h164 + XRT | | LIVP 1.1.1 + XRT | |
|---|---|---|---|---|---|---|
| hpi | Average | Std Dev | Average | Std Dev | Average | Std Dev |
| 0 | 1.28E+03 | 0.00E+00 | 1.28E+03 | 0.00E+00 | 1.28E+03 | 0.00E+00 |
| 24 | 1.71E+04 | 2.74E+03 | 3.76E+04 | 6.43E+03 | 4.67E+06 | 1.63E+06 |
| 48 | 5.83E+05 | 2.13E+05 | 7.17E+05 | 2.32E+05 | 5.83E+07 | 8.04E+06 |
| 72 | 2.25E+06 | 4.33E+05 | 3.75E+06 | 1.00E+06 | 4.33E+07 | 5.77E+06 |

Example 5

In Vitro Virus Replication Studies with LIVP Isolate 5.1.1

In this example, in vitro virus replication of LIVP isolate 5.1.1 was examined and compared to that of vaccinia virus GLV-1h68 (described in Example 1 and U.S. Pat. No. 7,588,767) in A549 human lung carcinoma and 4T1 murine mammary carcinoma cells. Viral growth was evaluated in supernatant and cell lysate.

1. A549 Human Lung Carcinoma Cells

Human A549 lung carcinoma cells (ATCC®) were grown in 24 well plates in F-12K Medium and were infected with vaccinia viruses GLV-1h68 or LIVP isolate 5.1.1 at a MOI of 0.1 at 37° C. The virus supernatant and cell lysates were collected at 1, 6, 12, 24, 48, 72 and 96 hours post infection and were titrated in CV-1 cells in triplicate using standard methods.

The results are presented in Table 19 below, which sets forth the replication efficiency, expressed as the average plaque forming units per milliliter (pfu/mL), and the standard deviation. The data shows that LIVP 5.1.1 can replicate more efficiently than GLV-1h68 in A549 cells.

TABLE 19

Viral growth in A549 human lung carcinoma cells

| | GLV-1h68 Supernatant | | GLV-1h68 Lysate | | LIVP 5.1.1 Supernatant | | LIVP 5.1.1 Lysate | |
|---|---|---|---|---|---|---|---|---|
| hpi | Average | Std Dev | Average | Std Dev | Average | Std Dev | Average | Std Dev |
| 1 | 1.00E+02 | 6.07E+01 | 6.67E+01 | 4.84E+01 | 4.20E+02 | 1.91E+02 | 7.73E+02 | 2.20E+02 |
| 6 | 1.00E+02 | 5.51E+01 | 2.00E+01 | 2.19E+01 | 2.60E+02 | 8.29E+01 | 5.80E+02 | 1.61E+02 |
| 12 | 8.00E+01 | 3.58E+01 | 1.53E+02 | 4.68E+01 | 3.60E+02 | 1.48E+02 | 1.08E+04 | 2.07E+03 |
| 24 | 9.33E+02 | 3.27E+02 | 9.07E+03 | 2.23E+03 | 1.73E+03 | 7.00E+02 | 5.93E+05 | 1.20E+05 |
| 48 | 2.80E+03 | 8.00E+02 | 1.45E+05 | 4.42E+04 | 3.73E+04 | 1.35E+04 | 3.72E+06 | 1.54E+05 |
| 72 | 2.00E+04 | 9.12E+03 | 2.95E+05 | 5.70E+04 | 1.18E+05 | 3.79E+04 | 3.33E+06 | 5.47E+05 |
| 96 | 6.20E+04 | 2.77E+04 | 2.17E+05 | 5.28E+04 | 2.58E+05 | 5.09E+04 | 1.49E+06 | 2.20E+05 |

2. 4T1 Murine Mammary Carcinoma Cells

Mouse 4T1 mammary carcinoma cell (ATCC®) were grown in 24 well plates in RPMI-1640 Medium and were infected with vaccinia viruses GLV-1h68 or LIVP isolate 5.1.1 at a MOI of 0.01 at 37° C. The virus supernatant and cell lysates were collected at 2, 6, 12, 24, 48, 72 and 96 hours post infection and were titrated in CV-1 cells in triplicate using standard methods.

The results are presented in Table 20 below, which sets forth the replication efficiency, expressed as the average plaque forming units per milliliter (pfu/mL), and the standard deviation. The data shows that LIVP 5.1.1 can replicate more efficiently than GLV-1h68 in 4T1 cells.

TABLE 20

| | GLV-1h68 Supernatant | | GLV-1h68 Lysate | | LIVP 5.1.1 Supernatant | | LIVP 5.1.1 Lysate | |
|---|---|---|---|---|---|---|---|---|
| hpi | Average | Std Dev | Average | Std Dev | Average | Std Dev | Average | Std Dev |
| 1 | 2.40E+01 | 1.68E+01 | 3.33E+01 | 2.73E+01 | 8.33E+01 | 5.57E+01 | 2.40E+02 | 1.10E+02 |
| 6 | 1.33E+01 | 1.49E+01 | 1.00E+01 | 1.67E+01 | 1.23E+02 | 5.57E+01 | 1.47E+02 | 6.53E+01 |
| 12 | 2.00E+01 | 8.39E+00 | 2.67E+01 | 2.73E+01 | 1.33E+02 | 8.91E+01 | 2.13E+02 | 7.45E+01 |
| 24 | 1.47E+01 | 7.87E+00 | 5.33E+01 | 5.01E+01 | 9.33E+01 | 6.53E+01 | 1.07E+04 | 2.37E+03 |
| 48 | 1.07E+01 | 8.26E+00 | 1.03E+02 | 8.98E+01 | 7.33E+02 | 3.01E+02 | 1.20E+05 | 2.12E+04 |
| 72 | 1.60E+01 | 1.13E+01 | 5.00E+01 | 3.74E+01 | 4.20E+03 | 9.03E+02 | 6.47E+04 | 2.51E+04 |
| 96 | 3.33E+01 | 1.63E+01 | 4.00E+01 | 3.35E+01 | 3.20E+04 | 6.69E+03 | 1.87E+04 | 6.53E+03 |

Example 6

In Vitro Cytotoxicity of LIVP Clonal Isolates

In this example, viral cytotoxicity of LIVP isolates 1.1.1 and 5.1.1 was measured in vitro in various cancer cell lines using an XTT cell proliferation assay. Toxicity was measured with or without prior radiation treatment.

A. In Vitro Cytotoxicity of LIVP Clonal Isolate 1.1.1

1. B16-F10 Mouse Melanoma Cells

Mouse melanoma B16-F10 cells (ATCC No. CRL-6475; American Type Culture Collection (Manassas, Va.)) were grown in DMEM medium and were infected with vaccinia viruses GLV-1h68, GLV-1h164 or LIVP clonal isolate 1.1.1 at a MOI of 0.01 for 24 hours at 37° C.

Radiation treatment (XRT): The cells were irradiated at a dosage of 6 Gy one day before virus infection and compared to cells receiving no radiation. Irradiation was administered as a single fraction using a RS2000 X-ray biological irradiator (Rad Source Technologies Inc.). The dose rate of radiation was 1 Gy/minute.

Cell toxicity was measured at 1, 3, 5 and 7 days post infection with a Cell Proliferation Kit II (XTT) (Roche). At each time point post virus infection, 50 µl, XTT labeling mixture was added per well and incubated for 4 hours at 37° C. with 6.5% $CO_2$. Spectrophotometrical absorbance of the samples was measured using a microplate (ELISA) reader. The wavelength to measure absorbance of the formazan product is between 450 and 500 nm according to the filters available for the ELISA reader used. The reference wavelength was greater than 650 nm.

The results are set forth in Table 21 below. Cytotoxicity efficacy is expressed as cell viability (no cell death=1), normalized to no treatment. As shown in the Table, LIVP 1.1.1 induced slightly higher cytotoxicity of the B16-F10 mouse melanoma cells compared to GLV-1h68 and GLV-1h164 treatment at 3-5 days post infection. Radiation treatment did not enhance cytotoxicity in the B16-F10 cells.

TABLE 21

| Cytotoxicity in B16-F10 mouse melanoma cells | | | | | | | | |
|---|---|---|---|---|---|---|---|---|
| Days p.i. | No treatment | | GLV-1h68 | | GLV-1h164 | | LIVP 1.1.1 | |
| | Average | Std Dev | Average | Std Dev | Average | Std Dev | Average | Std Dev |
| 1 | 1.0000 | 0.0490 | 0.9102 | 0.0539 | 0.8666 | 0.0771 | 0.9609 | 0.0833 |
| 3 | 1.0367 | 0.0269 | 1.0000 | 0.0098 | 0.9674 | 0.0067 | 0.9545 | 0.0254 |
| 5 | 0.8652 | 0.2234 | 0.8710 | 0.0595 | 0.8151 | 0.1612 | 0.7255 | 0.2372 |
| 7 | 0.0831 | 0.2025 | −0.5113 | 0.3082 | −0.3765 | 0.0396 | −0.0167 | 0.1393 |
| Days p.i. | No Treatment + XRT | | GLV-1h68 + XRT | | GLV-1h164 + XRT | | LIVP 1.1.1 + XRT | |
| | Average | Std Dev | Average | Std Dev | Average | Std Dev | Average | Std Dev |
| 1 | 0.7798 | 0.0350 | 0.5906 | 0.0095 | 0.5957 | 0.0498 | 0.4974 | 0.0169 |
| 3 | 1.0105 | 0.0495 | 1.0036 | 0.1085 | 1.0491 | 0.0947 | 1.0487 | 0.0788 |
| 5 | 0.7413 | 0.0409 | 0.7138 | 0.0412 | 0.7568 | 0.0627 | 0.7202 | 0.0689 |
| 7 | 0.0049 | 0.0045 | −0.0145 | 0.0308 | 0.0023 | 0.0028 | −0.0047 | 0.0118 |

2. A549 Human Lung Carcinoma Cells

Human A549 lung carcinoma cells (ATCC®) were grown in F-12K Medium and were infected with vaccinia viruses GLV-1h68, GLV-1h164, or LIVP isolate 1.1.1 at a MOI of 0.01 for 24 hours at 37° C. The cells were irradiated with 6 Gy gamma radiation or received no radiation treatment as described above. Cell toxicity was measured at 1, 3, 5 and 7 days post infection with Cell Proliferation Kit II (XTT), Roche, as described above.

The results are set forth in Table 22 below. Cytotoxicity efficacy is expressed as cell viability (no cell death=1), normalized to no treatment. As shown in the Table, LIVP 1.1.1 induced significantly higher cytotoxicity of the A549 lung carcinoma cells compared to GLV-1h68 and GLV-1h164 treatment. Radiation treatment did not enhance cytotoxicity in the A549 cells.

TABLE 22

| | Cytotoxicity in A549 human lung carcinoma cells | | | | | | | |
|---|---|---|---|---|---|---|---|---|
| Days | No treatment | | GLV-1h68 | | GLV-1h164 | | LIVP 1.1.1 | |
| p.i. | Average | Std Dev | Average | Std Dev | Average | Std Dev | Average | Std Dev |
| 1 | 1.0000 | 0.0244 | 0.9469 | 0.0404 | 0.9462 | 0.0511 | 0.9027 | 0.0615 |
| 3 | 1.0273 | 0.0783 | 0.9723 | 0.0387 | 0.9931 | 0.0662 | 0.9824 | 0.0530 |
| 5 | 1.0925 | 0.0151 | 0.6579 | 0.0679 | 0.6927 | 0.0778 | 0.0564 | 0.0080 |
| 7 | 0.8003 | 0.0606 | 0.0561 | 0.0244 | 0.0540 | 0.0099 | 0.0078 | 0.0015 |
| Days | No Treatment + XRT | | GLV-1h68 + XRT | | GLV-1h164 + XRT | | LIVP 1.1.1 + XRT | |
| p.i. | Average | Std Dev | Average | Std Dev | Average | Std Dev | Average | Std Dev |
| 1 | 1.0350 | 0.0237 | 0.9778 | 0.0457 | 0.9703 | 0.0396 | 0.9683 | 0.0607 |
| 3 | 1.0200 | 0.0627 | 1.0057 | 0.0437 | 1.0035 | 0.0345 | 1.0153 | 0.0372 |
| 5 | 1.1328 | 0.0349 | 0.6837 | 0.0822 | 0.6659 | 0.0726 | 0.1440 | 0.0153 |
| 7 | 0.8423 | 0.1760 | 0.0337 | 0.0118 | 0.0366 | 0.0092 | 0.0040 | 0.0027 |

3. MDA-MB-231 Human Breast Carcinoma Cells

Human MDA-MB-231 breast carcinoma cells (ATCC®) were grown in Leibovitz's L-15 Medium and were infected with vaccinia viruses GLV-1h68, GLV-1h164, or LIVP isolate 1.1.1 at a MOI of 0.01 for 24 hours at 37° C. The cells were irradiated with 6 Gy gamma radiation or received no radiation treatment as described above. Cell toxicity was measured at 1, 3, 5 and 7 days post infection with Cell Proliferation Kit II (XTT), Roche, as described above.

The results are set forth in Table 23 below. Cytotoxicity efficacy is expressed as cell viability (no cell death=1), normalized to no treatment. As shown in the Table, LIVP 1.1.1 induced significantly higher cytotoxicity of the MDA-MB-231 breast carcinoma cells compared to GLV-1h68 and GLV-1h164 treatment. Radiation treatment did not enhance cytotoxicity of LIVP 1.1.1 in the MDA-MB-231 cells, but did enhance the cytotoxicity of the GLV-1h164 strain.

TABLE 23

| | Cytotoxicity in MDA-MB-231 human breast carcinoma cells | | | | | | | |
|---|---|---|---|---|---|---|---|---|
| Days | No treatment | | GLV-1h68 | | GLV-1h164 | | LIVP 1.1.1 | |
| p.i. | Average | Std Dev | Average | Std Dev | Average | Std Dev | Average | Std Dev |
| 1 | 1.0000 | 0.0352 | 0.9370 | 0.0184 | 0.9205 | 0.0371 | 0.9034 | 0.0268 |
| 3 | 1.1674 | 0.0319 | 1.0368 | 0.0399 | 1.0113 | 0.0300 | 0.8888 | 0.0377 |
| 5 | 1.2225 | 0.1287 | 0.7901 | 0.1531 | 0.7582 | 0.1669 | 0.3826 | 0.1910 |
| 7 | 1.2390 | 0.0120 | 0.5518 | 0.0197 | 0.5181 | 0.0229 | 0.0813 | 0.0044 |
| Days | No Treatment + XRT | | GLV-1h68 + XRT | | GLV-1h164 + XRT | | LIVP 1.1.1 + XRT | |
| p.i. | Average | Std Dev | Average | Std Dev | Average | Std Dev | Average | Std Dev |
| 1 | 1.0703 | 0.0220 | 1.0302 | 0.0210 | 0.9888 | 0.0293 | 1.0234 | 0.0560 |
| 3 | 1.1277 | 0.0241 | 0.9703 | 0.0317 | 0.9482 | 0.0161 | 0.7992 | 0.0220 |
| 5 | 0.9238 | 0.0099 | 0.7144 | 0.0318 | 0.6117 | 0.0587 | 0.3560 | 0.0307 |
| 7 | 0.9389 | 0.0256 | 0.5563 | 0.0518 | 0.3034 | 0.2146 | 0.0736 | 0.0100 |

4. MIA PaCa-2 Human Pancreatic Carcinoma Cells

Human MIA PaCa-2 pancreatic carcinoma cells (ATCC®) were grown in DMEM medium and were infected with vaccinia viruses GLV-1h68, GLV-1h164, or LIVP isolate 1.1.1 at a MOI of 0.01 for 24 hours at 37° C. The cells were irradiated with 6 Gy gamma radiation or received no radiation treatment as described above. Cell toxicity was measured at 1, 3, 5 and 7 days post infection with Cell Proliferation Kit II (XTT), Roche, as described above.

The results are presented in Table 24 below. Cytotoxicity efficacy is expressed as cell viability (no cell death=1), normalized to no treatment. As shown in the Table, LIVP 1.1.1 induced significantly higher cytotoxicity of the MIA PaCa-2 pancreatic carcinoma cells compared to GLV-1h68 and GLV-1h164 treatment. Radiation treatment slightly enhanced cytotoxicity of LIVP 1.1.1 in the MiaPaCa-2 cells.

TABLE 24

Cytotoxicity in MIA PaCa-2 human pancreatic carcinoma cells

| Days p.i. | No treatment | | GLV-1h68 | | GLV-1h164 | | LIVP 1.1.1 | |
|---|---|---|---|---|---|---|---|---|
| | Average | Std Dev | Average | Std Dev | Average | Std Dev | Average | Std Dev |
| 1 | 1.0000 | 0.0381 | 0.9454 | 0.0189 | 0.9383 | 0.0267 | 0.9429 | 0.0196 |
| 3 | 0.9338 | 0.0385 | 0.8597 | 0.0278 | 0.8113 | 0.0168 | 0.7112 | 0.0313 |
| 5 | 0.9275 | 0.0083 | 0.4876 | 0.0093 | 0.4857 | 0.0129 | 0.3238 | 0.0145 |
| 7 | 1.0180 | 0.1760 | 0.1808 | 0.0745 | 0.1499 | 0.0150 | 0.0547 | 0.0328 |

| Days p.i. | No Treatment + XRT | | GLV-1h68 + XRT | | GLV-1h164 + XRT | | LIVP 1.1.1 + XRT | |
|---|---|---|---|---|---|---|---|---|
| | Average | Std Dev | Average | Std Dev | Average | Std Dev | Average | Std Dev |
| 1 | 1.0036 | 0.0272 | 0.8772 | 0.1197 | 0.9171 | 0.0298 | 0.9003 | 0.0361 |
| 3 | 0.9186 | 0.0097 | 0.7951 | 0.0174 | 0.7711 | 0.0087 | 0.5760 | 0.0244 |
| 5 | 0.9726 | 0.0924 | 0.4018 | 0.0283 | 0.4066 | 0.0126 | 0.2291 | 0.0071 |
| 7 | 0.9635 | 0.1061 | 0.1081 | 0.0371 | 0.0942 | 0.0145 | 0.0322 | 0.0186 |

5. PC-3 Human Prostate Cancer Cells

Human PC-3 prostate cancer cells (ATCC®) were grown in F-12K Medium and were infected with vaccinia viruses GLV-1h68, GLV-1h164, or LIVP isolate 1.1.1 at a MOI of 0.01 for 24 hours at 37° C. The cells were irradiated with 6 Gy gamma radiation or received no radiation treatment as described above. Cell toxicity was measured at 1, 3, 5 and 7 days post infection with Cell Proliferation Kit II (XTT), Roche, as described above.

The results are set forth in Table 25 below. Cytotoxicity efficacy is expressed as cell viability (no cell death=1), normalized to no treatment. As shown in the Table, LIVP 1.1.1 induced higher cytotoxicity of the PC-3 prostate cancer ceiis compared to GLV-1h68 and GLV-1h164 treatment. Radiation treatment sightly enhanced cytotoxicity of LIVP 1.1.1 in the PC-3 cells.

TABLE 25

Cytotoxicity in human PC-3 prostate cancer cells

| Days p.i. | No treatment | | GLV-1h68 | | GLV-1h164 | | LIVP 1.1.1 | |
|---|---|---|---|---|---|---|---|---|
| | Average | Std Dev | Average | Std Dev | Average | Std Dev | Average | Std Dev |
| 1 | 1.0000 | 0.0646 | 0.9011 | 0.0896 | 0.9427 | 0.0382 | 0.8670 | 0.0448 |
| 3 | 1.2695 | 0.0497 | 0.7208 | 0.1164 | 0.8390 | 0.0872 | 0.6890 | 0.0236 |
| 5 | 1.0372 | 0.0768 | 0.3884 | 0.0208 | 0.4264 | 0.0310 | 0.1668 | 0.0093 |
| 7 | 0.8865 | 0.0195 | 0.1019 | 0.0264 | 0.1213 | 0.0314 | 0.0570 | 0.0146 |

| Days p.i. | No Treatment + XRT | | GLV-1h68 + XRT | | GLV-1h164 + XRT | | LIVP 1.1.1 + XRT | |
|---|---|---|---|---|---|---|---|---|
| | Average | Std Dev | Average | Std Dev | Average | Std Dev | Average | Std Dev |
| 1 | 0.9718 | 0.01.10 | 0.8343 | 0.0290 | 0.8377 | 0.0127 | 0.8895 | 0.0326 |
| 3 | 1.1729 | 0.0175 | 0.7647 | 0.0365 | 0.7473 | 0.0165 | 0.5235 | 0.0163 |
| 5 | 0.7378 | 0.0147 | 0.2879 | 0.0308 | 0.3047 | 0.0227 | 0.1232 | 0.0036 |
| 7 | 0.5878 | 0.0391 | 0.0754 | 0.0285 | 0.0693 | 0.0202 | 0.0426 | 0.0023 |

6. U-87 MG Human Glioblastoma-Astrocytoma Cells

Human U-87 MG glioblastoma-astrocytoma cells (ATCC®) were grown in and were infected with vaccinia viruses GLV-1h68, GLV-1h164, or LIVP isolate 1.1.1 at a MOI of 0.01 for 24 hours at 37° C. The cells were irradiated with 6 Gy gamma radiation or received no radiation treatment as described above. Cell toxicity was measured at 1, 3, 5 and 7 days post infection with Cell Proliferation Kit II (XTT), Roche, as described above.

The results are set forth in Table 26 below. Cytotoxicity efficacy is expressed as cell viability (no cell death=1), normalized to no treatment. As shown in the Table, LIVP 1.1.1 induced significantly higher cytotoxicity of the U-87 MG glioblastoma-astrocytoma cells compared to GLV-1h68 and GLV-1h164 treatment. Radiation treatment did not enhance cytotoxicity of LIVP 1.1.1 in the U-87 MG cells, but slightly enhanced the cytotoxicity of the GLV-1h164 strain.

TABLE 26

Cytotoxicity in U-87 MG human glioblastoma-astrocytoma cells

| Days p.i. | No treatment | | GLV-1h68 | | GLV-1h164 | | LIVP 1.1.1 | |
|---|---|---|---|---|---|---|---|---|
| | Average | Std Dev | Average | Std Dev | Average | Std Dev | Average | Std Dev |
| 1 | 1.0000 | 0.0574 | 0.8888 | 0.0117 | 0.9222 | 0.0299 | 0.9513 | 0.0049 |
| 3 | 1.2915 | 0.0576 | 1.2481 | 0.0606 | 1.2517 | 0.0627 | 0.9378 | 0.0596 |
| 5 | 1.3241 | 0.0453 | 1.2323 | 0.0354 | 1.1781 | 0.0236 | 0.2976 | 0.0230 |
| 7 | 1.2996 | 0.0578 | 1.1458 | 0.0232 | 1.0776 | 0.0593 | 0.0381 | 0.0286 |

| Days p.i. | No Treatment + XRT | | GLV-1h68 + XRT | | GLV-1h164 + XRT | | LIVP 1.1.1 + XRT | |
|---|---|---|---|---|---|---|---|---|
| | Average | Std Dev | Average | Std Dev | Average | Std Dev | Average | Std Dev |
| 1 | 1.0098 | 0.0563 | 0.9070 | 0.0331 | 0.9187 | 0.0390 | 0.9238 | 0.0422 |
| 3 | 1.2655 | 0.0971 | 1.2116 | 0.0986 | 1.1948 | 0.0530 | 0.8634 | 0.0497 |
| 5 | 1.2957 | 0.0761 | 1.1931 | 0.0731 | 1.1212 | 0.0967 | 0.3476 | 0.0403 |
| 7 | 1.2240 | 0.0721 | 1.0459 | 0.0636 | 0.7943 | 0.0536 | 0.0491 | 0.0054 |

B. In Vitro Cytotoxicity of LIVP Clonal Isolate 5.1.1

1. A549 Human Lung Carcinoma Cells

Human A549 lung carcinoma cells (ATCC®) were grown in 24 well plates in quadruplicates in F-12K Medium and were infected with vaccinia viruses GLV-1h68, LIVP isolate 5.1.1, PBS, GLV-1h68+5 µM ST-246, LIVP 5.1.1+5 µM ST-246 or PBS+5 µM ST-246 at a MOI of 0.1 for 24 hours at 37° C. Cell toxicity was measured at 24, 48 and 72 hours post infection with Cell Proliferation Kit II (XTT), Roche, as described above.

The results are presented in Table 27 below, which sets forth the average cell survival and standard deviation. LIVP 5.1.1 virus infection resulted in more efficient eradication of A549 cells compared to GLV-1h68 in cell culture. The addition of 5 µM ST-246 reduced the eradication of A549 cells by LIVP 5.1.1 and GLV-1h68.

TABLE 27

Cytotoxicity in human A549 lung carcinoma cells

| hpi | PBS | | GLV-1h68 | | LIVP 5.1.1 | |
|---|---|---|---|---|---|---|
| | Average Cell Survival (%) | Std Dev | Average Cell Survival (%) | Std Dev | Average Cell Survival (%) | Std Dev |
| 24 | 100 | 0.85 | 84.11 | 5.95 | 79.41 | 4.97 |
| 48 | 100 | 3.01 | 78.89 | 5.32 | 73.94 | 3.35 |
| 72 | 100 | 2.46 | 53.01 | 1.28 | 48.67 | 1.63 |

| hpi | PBS + ST-246 | | GLV-1h68 + ST-246 | | LIVP 5.1.1 + ST-246 | |
|---|---|---|---|---|---|---|
| | Average Cell Survival (%) | Std Dev | Average Cell Survival (%) | Std Dev | Average Cell Survival (%) | Std Dev |
| 24 | 100.48 | 3.68 | 89.93 | 7.20 | 80.89 | 2.53 |
| 48 | 92.66 | 3.81 | 98.53 | 4.81 | 97.25 | 6.70 |
| 72 | 93.96 | 3.64 | 89.81 | 3.17 | 89.81 | 6.99 |

Example 7

Effects of LIVP Clonal Isolates on Survival and Tumor Growth In Vivo

A. Effects of Viruses on DU145 Human Prostate Carcinoma Xenografts

The in vivo effects of LIVP clonal isolates 1.1.1, 2.1.1, 3.1.1, 4.1.1, 5.1.1, 6.1.1, 7.1.1, and 8.1.1 were evaluated using a mouse model of human prostate cancer. To evaluate the safety and antitumor efficacies of the viruses, male nude mice (Hsd:Athymic Nude-Foxn1$^{nu}$; Harlan, Indianapolis, Ind.; 4-5 weeks old) were injected subcutaneously (s.c. on the right lateral thigh $1.0 \times 10^7$ cells in 100 µL PBS) with DU145 cells (ATCC® No. HTB-81™; American Type Culture Collection (Manassas, Va.)) to establish tumors. Thirteen days following tumor cell implantation, groups of mice were administered via retro orbital injection $7.0 \times 10^5$ pfu LIVP clonal isolates 1.1.1, 2.1.1, 3.1.1, 4.1.1, 5.1.1, 6.1.1, 7.1.1, or 8.1.1, GLV-1h68, GLV-1h74, or wild-type LIVP (in 100 µL of PBS) or PBS alone. Tumor volume (mm$^3$) was measured at 13, 20, 27, 34, 41, 48, 55, 62 and 69 days post-cancer cell injection.

The Therapeutic Index for each virus was calculated using the formula: $(AUC_{untreated} - AUC_{virus})/AUC_{untreated} \times 100$. The area under the curve (AUC) for each group tested was calculated using a graph of the Median Change in Tumor Volume (y) over Time (x). The AUC of the plotted data for each group was calculated using the Trapezoid Rule. Briefly, for each time interval (7 days), the formula of [(Median Change in Tumor Volume at the last day of that time interval)+(Median Change in Tumor Volume at the first day of that time interval)/2*(Time between the interval) (7 days)] was used to calculate the AUC for that time interval. The total AUC for each plotted line was calculated by adding the AUCs for each time interval (up to day 55 post tumor implantation) and multiplying by 7 (the first time interval).

To measure toxicity of the viruses, net body weight and survival of the mice over the course of the experiments were monitored. Net body weight (grams) was calculated by subtracting the weight of the tumor (tumor volume/1000) from the total weight of the animal. The resulting weight represents the weight of the animal not including the tumor.

The results are set forth in Tables 28-31 below. Table 28 sets forth the median tumor volumes. Table 29 sets forth the resulting AUCs and therapeutic indices for each virus. Table 30 sets forth the net body weights of the mice. Table 31 sets forth the data for percentage survival rate of the mice. LIVP 1.1.1, 5.1.1, 6.1.1 and GLV-1h68 were the least toxic, with all mice surviving for 57 days post tumor cell implantation and maintaining body weight. All viruses tested caused a reduction in tumor cell growth. All of the LIVP clonal isolates had a higher therapeutic index than GLV-1h68. LIVP clonal isolates 1.1.1, 5.1.1 and 6.1.1 showed good tumor reduction without any cytotoxic side effects.

TABLE 28

Effect of viruses on DU145 tumor cell growth

Median tumor volume (mm$^3$)

| Days P.I. | Cntrl | LIVP | GLV-1h68 | GLV-1h74 | LIVP 1.1.1 | LIVP 2.1.1 | LIVP 3.1.1 | LIVP 4.1.1 | LIVP 5.1.1 | LIVP 6.1.1 | LIVP 7.1.1 | LIVP 8.1.1 |
|---|---|---|---|---|---|---|---|---|---|---|---|---|
| 13 | 310.53 | 401.55 | 359.25 | 417.96 | 340.98 | 316.19 | 376.74 | 357.25 | 318.64 | 394.49 | 337.45 | 308.71 |
| 20 | 542.95 | 716.99 | 703.68 | 714.83 | 625.09 | 673.36 | 702.89 | 619.56 | 755.90 | 661.43 | 683.98 | 599.12 |
| 27 | 905.67 | 844.70 | 1040.75 | 912.05 | 900.04 | 869.35 | 884.22 | 627.87 | 929.70 | 786.31 | 841.38 | 843.45 |
| 34 | 1315.76 | 884.35 | 1471.85 | 1127.25 | 1212.05 | 1100.26 | 904.64 | 521.95 | 992.20 | 930.47 | 824.45 | 933.40 |
| 41 | 1684.20 | 548.74 | 1672.22 | 1029.72 | 725.83 | 1087.58 | 735.20 | 369.54 | 910.59 | 871.98 | 829.83 | 659.79 |
| 48 | 2069.49 | 187.93 | 1771.80 | 836.15 | 452.00 | 781.16 | 462.60 | 216.87 | 574.26 | 868.82 | 434.97 | 580.20 |
| 55 | 2707.20 | — | 1781.31 | 579.40 | 414.80 | 703.28 | 410.24 | 121.92 | 494.33 | 773.04 | 461.73 | 313.47 |
| 62 | — | — | 1470.50 | 231.91 | 271.78 | 433.10 | 379.89 | — | 441.51 | 703.43 | 341.51 | — |
| 69 | — | — | 1442.53 | — | 224.68 | 395.51 | — | — | 373.15 | 716.12 | 310.75 | — |

TABLE 29

Therapeutic Index

| Virus Treatment | Area (AUC) | Therapeutic Index |
|---|---|---|
| Control | 97261.37 | |
| GLV-1h68 | 76041.38 | 21.82 |
| GLV-1h74 | 30608.98 | 68.53 |
| LIVP 1.1.1 | 32290.02 | 66.80 |
| LIVP 2.1.1 | 48416.42 | 50.22 |
| LIVP 3.1.1 | 23705.58 | 75.63 |
| LIVP 4.1.1 | 6198.02 | 93.63 |
| LIVP 5.1.1 | 40862.65 | 57.99 |
| LIVP 6.1.1 | 29013.09 | 70.17 |
| LIVP 7.1.1 | 28888.65 | 70.30 |
| LIVP 8.1.1 | 32931.87 | 66.14 |

TABLE 30

Net Body Weight

Net body weight (g)

| Days P.I. | Cntrl | LIVP | GLV-1h68 | GLV-1h74 | LIVP 1.1.1 | LIVP 2.1.1 | LIVP 3.1.1 | LIVP 4.1.1 | LIVP 5.1.1 | LIVP 6.1.1 | LIVP 7.1.1 | LIVP 8.1.1 |
|---|---|---|---|---|---|---|---|---|---|---|---|---|
| 13 | 25.85 | 28.61 | 26.44 | 28.71 | 28.67 | 26.97 | 26.75 | 28.96 | 27.38 | 28.30 | 27.84 | 29.90 |
| 20 | 27.25 | 27.97 | 27.11 | 27.57 | 28.42 | 27.45 | 25.60 | 28.94 | 26.59 | 28.45 | 27.80 | 31.46 |
| 27 | 28.72 | 27.47 | 28.72 | 29.05 | 28.57 | 27.40 | 25.28 | 29.97 | 27.67 | 29.36 | 28.32 | 32.60 |
| 34 | 28.51 | 26.24 | 28.18 | 28.99 | 29.33 | 27.52 | 25.65 | 27.81 | 28.04 | 29.62 | 28.18 | 30.72 |
| 41 | 28.78 | 24.39 | 28.54 | 27.66 | 30.57 | 28.61 | 29.56 | 25.39 | 30.14 | 30.25 | 27.28 | 29.39 |
| 48 | 29.15 | 23.69 | 29.12 | 27.76 | 30.58 | 29.18 | 28.91 | 21.01 | 29.59 | 30.28 | 25.33 | 27.65 |
| 55 | 28.27 | — | 28.96 | 27.30 | 30.74 | 28.83 | 26.94 | 18.68 | 30.31 | 30.33 | 25.16 | 27.09 |
| 62 | — | — | 29.28 | 31.69 | 31.26 | 27.31 | 22.40 | — | 30.70 | 31.77 | 23.23 | — |
| 69 | — | — | 29.09 | — | 30.36 | 26.84 | — | — | 30.50 | 31.58 | 22.36 | — |

TABLE 31

Survival Rate

Survival Rate (%)

| Days P.I. | Cntrl | LIVP | GLV-1h68 | GLV-1h74 | LIVP 1.1.1 | LIVP 2.1.1 | LIVP 3.1.1 | LIVP 4.1.1 | L1VP 5.1.1 | LIVP 6.1.1 | LIVP 7.1.1 | LIVP 8.1.1 |
|---|---|---|---|---|---|---|---|---|---|---|---|---|
| 0 | 100 | 100 | 100 | 100 | 100 | 100 | 100 | 100 | 100 | 100 | 100 | 100 |
| 22 | 100 | 100 | 100 | 100 | 100 | 100 | 100 | 100 | 100 | 100 | 100 | 100 |
| 24 | 100 | 100 | 100 | 100 | 100 | 100 | 87.5 | 100 | 100 | 100 | 100 | 100 |
| 27 | 100 | 100 | 100 | 100 | 100 | 100 | 87.5 | 87.5 | 100 | 100 | 100 | 100 |
| 29 | 100 | 87.5 | 100 | 100 | 100 | 100 | 87.5 | 87.5 | 100 | 100 | 100 | 100 |
| 32 | 100 | 37.5 | 100 | 87.5 | 100 | 100 | 75 | 75 | 100 | 100 | 100 | 100 |
| 35 | 100 | 37.5 | 100 | 87.5 | 100 | 100 | 75 | 75 | 100 | 100 | 100 | 100 |
| 36 | 100 | 37.5 | 100 | 87.5 | 100 | 100 | 62.5 | 37.5 | 100 | 100 | 75 | 87.5 |
| 37 | 100 | 37.5 | 100 | 87.5 | 100 | 100 | 62.5 | 37.5 | 100 | 100 | 75 | 87.5 |
| 40 | 100 | 25 | 100 | 87.5 | 100 | 100 | 62.5 | 37.5 | 100 | 100 | 75 | 62.5 |
| 42 | 100 | 25 | 100 | 87.5 | 100 | 100 | 62.5 | 37.5 | 100 | 100 | 75 | 62.5 |
| 46 | nd | 0 | 100 | 75 | 100 | 100 | 62.5 | 12.5 | 100 | 100 | 62.5 | 37.5 |
| 48 | nd | 0 | 100 | 75 | 100 | 100 | 62.5 | 12.5 | 100 | 100 | 62.5 | 37.5 |
| 49 | nd | 0 | 100 | 50 | 100 | 87.5 | 62.5 | 12.5 | 100 | 100 | 50 | 37.5 |
| 51 | nd | 0 | 100 | 50 | 100 | 87.5 | 62.5 | 12.5 | 100 | 100 | 50 | 37.5 |
| 53 | nd | 0 | 100 | 50 | 100 | 75 | 37.5 | 12.5 | 100 | 100 | 50 | 37.5 |
| 55 | rid | 0 | 100 | 50 | 100 | 75 | 37.5 | 12.5 | 100 | 100 | 50 | 37.5 |
| 56 | nd | 0 | 100 | 50 | 100 | 62.5 | 25 | 0 | 100 | 100 | 37.5 | 25 |
| 57 | nd | 0 | 100 | 50 | 100 | 62.5 | 25 | 0 | 100 | 100 | 37.5 | 25 |

B. Effects of Viruses on DU145 Human Prostate Carcinoma Xenografts—Dosage Study

The in vivo effects of increasing doses of LIVP 1.1.1, 5.1.1 and 6.1.1 were evaluated using a mouse model of human prostate cancer. To evaluate the safety and antitumor efficacies of varying doses of the viruses, male nude mice (Hsd:Athymic Nude-Foxn1$^{nu}$; Harlan, Indianapolis, Ind.; 4-5 weeks old; n=8 per group) were injected subcutaneously (s.c. on the right lateral thigh $6.0\times10^6$ cells in 100 µL PBS) with DU145 cells (ATCC® no. HTB-81™; American Type Culture Collection (Manassas, Va.)) to establish tumors. Thirteen days following tumor cell implantation, groups of mice were administered via retro orbital injection with LIVP isolates 1.1.1 ($7.0\times10^5$ pfu, $2.0\times10^6$ pfu, or $1\times10^7$ pfu), 5.1.1 ($7.0\times10^5$ pfu, $2.0\times10^6$ pfu, or $1\times10^7$ pfu), or 6.1.1 ($7.0\times10^5$ pfu, $2.0\times10^6$ pfu, or $1\times10^7$ pfu), GLV-1h68 ($7.0\times10^5$ pfu, $2.0\times10^6$ pfu, or $1\times10^7$ pfu) (in 100 µL of PBS) or PBS alone. Tumor volume (mm$^3$) was measured at 13, 20, 27, 34, 41, 48, 55, 62 and 69 days post-cancer cell injection. The AUCs, therapeutic indices, and survival rates were calculated as described in Example 7A above.

The results are set forth in Tables 32-35 below. Table 32 sets forth the median tumor volumes. Table 33 sets forth the resulting AUCs and therapeutic indices for each virus. Table 34 sets forth the net body weights of the mice. Table 35 sets forth the data for percentage survival rate of the mice. A decrease in DU145 tumor growth was observed after treatment with all doses of LIVP isolates 1.1.1, 5.1.1 and 6.1.1 and GLV-1h68. Dosing at $2.0\times10^6$ pfu resulted in the highest therapeutic index for all viruses tested. GLV-1h68 was the most toxic and LIVP 5.1.1 was the least toxic, with LIVP isolates 1.1.1 and 6.1.1 have similar toxicity.

TABLE 32

Effect of viruses on DU145 tumor cell growth

Median tumor volume (mm$^3$)

| Days P.I. | Cntrl | GLV-1h68 $7.0 \times 10^5$ pfu | GLV-1h68 $2.0 \times 10^6$ pfu | GLV-1h68 $1 \times 10^7$ pfu | LIVP 1.1.1 $7.0 \times 10^5$ pfu | LIVP 1.1.1 $2.0 \times 10^6$ pfu | LIVP 1.1.1 $1 \times 10^7$ pfu |
|---|---|---|---|---|---|---|---|
| 13 | 137.88 | 133.26 | 127.12 | 144.92 | 132.08 | 133.63 | 113.99 |
| 20 | 209.81 | 179.84 | 202.99 | 216.54 | 221.05 | 225.09 | 148.72 |
| 27 | 340.88 | 308.68 | 413.51 | 437.14 | 437.75 | 371.71 | 229.08 |
| 34 | 584.44 | 401.53 | 621.92 | 563.89 | 384.37 | 210.39 | 274.99 |
| 41 | 1122.83 | 845.15 | 668.20 | 964.91 | 492.60 | 280.52 | 400.65 |
| 48 | 1392.76 | 1109.16 | 510.10 | 946.54 | 476.18 | 95.84 | 396.67 |
| 55 | 2319.05 | 1558.99 | 554.58 | 807.76 | 319.77 | 96.48 | 606.19 |
| 62 | 3653.76 | 1786.12 | 374.35 | 961.40 | 157.10 | 87.85 | 905.63 |
| 69 | 4195.73 | 2326.99 | 373.46 | 1306.21 | 202.46 | 125.84 | 1183.16 |

Median tumor volume (mm$^3$)

| Days P.I. | Cntrl | LIVP 5.1.1 $7.0 \times 10^5$ pfu | LIVP 5.1.1 $2.0 \times 10^6$ pfu | LIVP 5.1.1 $1 \times 10^7$ pfu | LIVP 6.1.1 $7.0 \times 10^5$ pfu | LIVP 6.1.1 $2.0 \times 10^6$ pfu | LIVP 6.1.1 $1 \times 10^7$ pfu |
|---|---|---|---|---|---|---|---|
| 13 | 137.88 | 89.11 | 111.74 | 121.18 | 127.28 | 141.42 | 129.65 |
| 20 | 209.81 | 149.74 | 175.01 | 174.51 | 195.17 | 209.20 | 192.61 |

TABLE 32-continued

Effect of viruses on DU145 tumor cell growth

| 27 | 340.88 | 206.49 | 338.89 | 359.80 | 404.90 | 310.91 | 383.25 |
|---|---|---|---|---|---|---|---|
| 34 | 584.44 | 250.65 | 282.51 | 486.05 | 432.21 | 234.60 | 434.55 |
| 41 | 1122.83 | 452.46 | 434.56 | 711.99 | 482.08 | 409.16 | 660.49 |
| 48 | 1392.76 | 457.71 | 377.64 | 571.72 | 369.14 | 266.64 | 595.77 |
| 55 | 2319.05 | 624.11 | 388.76 | 576.55 | 292.66 | 434.63 | 583.47 |
| 62 | 3653.76 | 345.56 | 317.82 | 835.88 | 216.32 | 261.37 | 384.76 |
| 69 | 4195.73 | 361.94 | 418.24 | 1141.66 | 215.58 | 296.79 | 330.08 |

TABLE 33

Therapeutic Index

| Virus Treatment | Area | Therapeutic Index |
|---|---|---|
| Control | 379803.91 | |
| GLV-1h68 7.0 × 10⁵ pfu | 233615.69 | 38.49 |
| GLV-1h68 2.0 × 10⁶ pfu | 99410.51 | 73.83 |
| GLV-1h68 1 × 10⁷ pfu | 150945.16 | 60.26 |
| LIVP 1.1.1 7.0 × 10⁵ pfu | 59340.59 | 84.38 |
| LIVP 1.1.1 2.0 × 10⁶ pfu | 15714.87 | 95.86 |
| LIVP 1.1.1 1 × 10⁷ pfu | 115997.02 | 69.46 |
| LIVP 5.1.1 7.0 × 10⁵ pfu | 109944.68 | 71.05 |
| LIVP 5.1.1 2.0 × 10⁶ pfu | 73946.59 | 80.53 |
| LIVP 5.1.1 1 × 10⁷ pfu | 136609.76 | 64.03 |
| LIVP 6.1.1 7.0 × 10⁵ pfu | 59503.93 | 84.33 |
| LIVP 6.1.1 2.0 × 10⁶ pfu | 42071.97 | 88.92 |
| LIVP 6.1.1 1 × 10⁷ pfu | 91749.06 | 75.84 |

TABLE 34

Net Body Weight

| Days P.I. | Cntrl | GLV-1h68 7.0 × 10⁵ pfu | GLV-1h68 2.0 × 10⁶ pfu | GLV-1h68 1 × 10⁷ pfu | LIVP 1.1.1 7.0 × 10⁵ pfu | LIVP 1.1.1 2.0 × 10⁶ pfu | LIVP 1.1.1 1 × 10⁷ pfu |
|---|---|---|---|---|---|---|---|
| 13 | 33.74 | 31.14 | 33.27 | 29.86 | 28.55 | 31.11 | 30.23 |
| 20 | 32.91 | 31.04 | 32.50 | 28.98 | 27.13 | 30.45 | 29.64 |
| 27 | 33.40 | 30.87 | 31.59 | 28.46 | 26.06 | 30.03 | 30.64 |
| 34 | 32.13 | 29.59 | 31.03 | 25.76 | 24.83 | 31.68 | 30.44 |
| 41 | 31.50 | 28.79 | 31.36 | 26.98 | 25.71 | 32.39 | 30.66 |
| 48 | 31.15 | 29.18 | 32.47 | 26.00 | 25.92 | 32.97 | 30.58 |
| 55 | 30.44 | 28.36 | 31.98 | 28.19 | 23.93 | 32.94 | 30.37 |
| 62 | 30.21 | 28.27 | 32.57 | 28.09 | 25.00 | 33.53 | 31.32 |
| 69 | 29.75 | 27.81 | 32.65 | 27.92 | 25.42 | 32.99 | 31.52 |

| Days P.I. | Cntrl | LIVP 5.1.1 7.0 × 10⁵ pfu | LIVP 5.1.1 2.0 × 10⁶ pfu | LIVP 5.1.1 1 × 10⁷ pfu | LIVP 6.1.1 7.0 × 10⁵ pfu | LIVP 6.1.1 2.0 × 10⁶ pfu | LIVP 6.1.1 1 × 10⁷ pfu |
|---|---|---|---|---|---|---|---|
| 13 | 33.74 | 31.27 | 28.10 | 30.13 | 30.29 | 32.39 | 30.13 |
| 20 | 32.91 | 30.48 | 27.33 | 29.08 | 29.55 | 31.90 | 29.82 |
| 27 | 33.40 | 32.31 | 27.18 | 28.67 | 30.83 | 33.69 | 29.99 |
| 34 | 32.13 | 33.05 | 27.92 | 28.48 | 31.00 | 34.07 | 30.17 |
| 41 | 31.50 | 31.18 | 29.73 | 28.80 | 32.42 | 34.09 | 30.74 |
| 48 | 31.15 | 31.52 | 29.35 | 30.25 | 32.93 | 32.90 | 31.22 |
| 55 | 30.44 | 31.54 | 30.22 | 30.83 | 30.81 | 36.11 | 28.74 |
| 62 | 30.21 | 33.25 | 29.28 | 31.13 | 27.80 | Nd | 31.52 |
| 69 | 29.75 | 32.92 | 28.62 | 29.23 | 27.96 | Nd | 31.84 |

TABLE 35

Survival Rate

Survival Rate (%)

| Days P.I. | Cntrl | GLV-1h68 7.0 × 10$^5$ pfu | GLV-1h68 2.0 × 10$^6$ pfu | GLV-1h68 1 × 10$^7$ pfu | LIVP 1.1.1 7.0 × 10$^5$ pfu | LIVP 1.1.1 2.0 × 10$^6$ pfu | LIVP 1.1.1 1 × 10$^7$ pfu |
|---|---|---|---|---|---|---|---|
| 0 | 100 | 100 | 100 | 100 | 100 | 100 | 100 |
| 11 | 100 | 100 | 100 | 100 | 100 | 100 | 100 |
| 20 | 100 | 100 | 100 | 100 | 100 | 100 | 100 |
| 35 | 100 | 100 | 100 | 100 | 83 | 100 | 100 |
| 36 | 100 | 100 | 100 | 100 | 83 | 100 | 100 |
| 42 | 100 | 100 | 100 | 83 | 83 | 100 | 100 |
| 43 | 100 | 100 | 100 | 83 | 83 | 100 | 100 |
| 45 | 100 | 100 | 80 | 83 | 83 | 100 | 100 |
| 49 | 100 | 100 | 80 | 83 | 83 | 100 | 100 |
| 52 | 100 | 100 | 80 | 83 | 50 | 100 | 83 |
| 55 | 100 | 100 | 80 | 83 | 50 | 100 | 83 |

Survival Rate (%)

| Days P.I. | Cntrl | LIVP 5.1.1 7.0 × 10$^5$ pfu | LIVP 5.1.1 2.0 × 10$^6$ pfu | LIVP 5.1.1 1 × 10$^7$ pfu | LIVP 6.1.1 7.0 × 10$^5$ pfu | LIVP 6.1.1 2.0 × 10$^6$ pfu | LIVP 6.1.1 1 × 10$^7$ pfu |
|---|---|---|---|---|---|---|---|
| 0 | 100 | 100 | 100 | 100 | 100 | 100 | 100 |
| 11 | 100 | 100 | 100 | 100 | 83 | 100 | 100 |
| 20 | 100 | 100 | 100 | 100 | 83 | 100 | 100 |
| 35 | 100 | 100 | 80 | 100 | 83 | 100 | 100 |
| 36 | 100 | 100 | 80 | 100 | 83 | 100 | 100 |
| 42 | 100 | 100 | 80 | 100 | 83 | 100 | 100 |
| 43 | 100 | 100 | 80 | 100 | 83 | 100 | 100 |
| 45 | 100 | 83 | 80 | 100 | 83 | 100 | 83 |
| 49 | 100 | 83 | 80 | 100 | 83 | 100 | 83 |
| 52 | 100 | 83 | 60 | 100 | 67 | 100 | 83 |
| 55 | 100 | 83 | 60 | 100 | 67 | 100 | 83 |

C. Effects of LIVP 1.1.1 on OE19 Human Esophageal Carcinoma Xenografts

The in vivo effects of LIVP 1.1.1 were evaluated using a mouse model of human esophageal cancer. To evaluate the safety and antitumor efficacies of the viruses, male nude mice (Hsd:Athymic Nude-Foxn1$^{nu}$; Harlan, Indianapolis, Ind.; 4-5 weeks old; n=5 per group) were injected subcutaneously (s.c. on the right lateral thigh 2.0×10$^6$ cells in 100 µL PBS) with OE19 cells (Sigma Aldrich) to establish tumors. Thirteen days following tumor cell implantation (tumor size >300 mm$^3$), groups of mice (n=5) were administered via retro orbital injection with 2.0×10$^6$ pfu LIVP isolate 1.1.1, GLV-1h68, or GLV-1h164 (in 100 µL of PBS) or PBS alone. Tumor volume (mm$^3$) was measured at 13, 20, 27, 34, 41, 48, 55 and 62 days post-cancer cell injection.

To measure toxicity of the viruses, net body weight and survival of the mice over the course of the experiments were monitored. Net body weight (grams) was calculated by subtracting the weight of the tumor (tumor volume/1000) from the total weight of the animal. The resulting weight represents the weight of the animal not including the tumor.

The results are set forth in Tables 36-38 below. Table 36 sets forth the median tumor volumes. Table 37 sets forth the net body weights of the mice. Table 38 sets forth the data for percentage survival rate of the mice. LIVP isolate 1.1.1 was most effective at reducing OE19 tumor cell growth. Untreated mice and mice treated with GLV-1h68 were sacrificed by day 35 due to tumor size and/or health issues. Treatment with GLV-1h64 and LIVP isolate 1.1.1 reduced tumor size and overall health and increased survival rate.

TABLE 36

Effect of viruses on OE19 tumor cell growth

| Days P.I. | Median tumor volume (mm$^3$) | | | |
|---|---|---|---|---|
| | Cntrl | GLV-1h68 | GLV-1h164 | LIVP 1.1.1 |
| 13 | 248.75 | 147.45 | 160.48 | 153.66 |
| 20 | 1130.77 | 722.59 | 448.55 | 678.91 |
| 27 | 2270.11 | 1079.49 | 619.74 | 734.08 |
| 34 | — | 2089.88 | 822.56 | 710.78 |
| 41 | — | 3459.79 | 1151.27 | 1241.51 |
| 48 | — | — | 1920.09 | 1407.14 |
| 55 | — | — | 3029.65 | 2424.54 |
| 62 | — | — | 4350.53 | 3424.26 |

TABLE 37

Net Body Weight

| Days P.I. | Net body weight (g) | | | |
|---|---|---|---|---|
| | Cntrl | GLV-1h68 | GLV-1h164 | LIVP 1.1.1 |
| 13 | 27.70 | 27.15 | 30.11 | 25.86 |
| 20 | 24.58 | 25.18 | 27.95 | 21.49 |
| 27 | 22.78 | 19.57 | 26.76 | 24.29 |
| 34 | — | 25.06 | 27.59 | 28.21 |
| 41 | — | 24.49 | 26.95 | 26.72 |
| 48 | — | — | 24.88 | 24.97 |
| 55 | — | — | 25.02 | 23.78 |
| 62 | — | — | 25.05 | 23.03 |

TABLE 38

Survival

| Days P.I. | Cntrl | UZ,7/31 Survival Rate (%) GLV-1h68 | GLV-1h164 | LIVP 1.1.1 |
|---|---|---|---|---|
| 0 | 100 | 100 | 100 | 100 |
| 7 | 100 | 100 | 100 | 100 |
| 14 | 100 | 100 | 100 | 100 |
| 21 | 100 | 100 | 100 | 100 |
| 28 | 100 | 100 | 100 | 100 |
| 35 | — | — | 100 | 100 |
| 37 | — | — | 100 | 100 |
| 42 | — | — | 80 | 100 |
| 48 | — | — | 80 | 100 |
| 49 | — | — | 80 | 60 |

— = mice killed due to tumor size and/or health of the mice

D. Effects of LIVP 1.1.1 on U-87 MG Human Glioblastoma Xenografts

The in vivo effects of LIVP 1.1.1 were evaluated using a mouse model of human glioma. To evaluate the safety and antitumor efficacies of the viruses, male nude mice (Hsd: Athymic Nude-Foxn1$^{nu}$; Harlan, Indianapolis, Ind.; 4-5 weeks old) were injected subcutaneously (s.c. on the right lateral thigh $5.0 \times 10^6$ cells in 100 μL PBS) with U-87 MG glioblastoma-astrocytoma cells (ATCC®) to establish tumors. Fourteen days following tumor cell implantation (tumor size >200 mm$^3$), groups of mice (n=8) were administered via retro orbital injection $2.0 \times 10^6$ pfu LIVP isolate 1.1.1 or GLV-1h68 (in 100 μL of PBS) or PBS alone. Tumor volume (mm$^3$) was measured at −1, 2, 6, 9, 13, 16, 20, 23, 27, 30, 34, 37, 41, 44, 48, 51 and 55 days post-cancer cell injection.

To measure toxicity of the viruses, net body weight and survival of the mice over the course of the experiments was monitored. Net body weight (grams) was calculated by subtracting the weight of the tumor (tumor volume/1000) from the total weight of the animal. The resulting weight represents the weight of the animal not including the tumor.

Results of median tumor volume are provided in Table 39. Tumor growth, as indicated by fractional tumor volume (V/Vo), is set forth in Table 40. Net body weight is set forth in Table 41. Net body weight remained steady for all animals. LIVP isolate 1.1.1 was more effective at inhibiting tumor growth than GLV-1h68, which was slightly better than control.

TABLE 39

Effect of viruses on U-87 tumor cell growth

| Days P.I. | Median tumor volume (mm$^3$) Cntrl | GLV-1h68 | LIVP 1.1.1 |
|---|---|---|---|
| −1 | 217.65 | 167.25 | 190.02 |
| 2 | 314.34 | 241.53 | 269.91 |
| 6 | 417.32 | 356.39 | 404.62 |
| 9 | 693.64 | 534.24 | 577.10 |
| 13 | 1080.09 | 916.43 | 728.24 |
| 16 | 1384.13 | 1198.12 | 798.15 |
| 20 | 1919.33 | 1892.81 | 742.00 |
| 23 | 2709.30 | 2390.18 | 758.81 |
| 27 | — | 2849.00 | 669.90 |
| 30 | — | — | 655.13 |
| 34 | — | — | 540.41 |
| 37 | — | — | 516.25 |
| 41 | — | — | 445.37 |
| 44 | — | — | 405.92 |
| 48 | — | — | 398.67 |
| 51 | — | — | 471.02 |
| 55 | — | — | 461.90 |

TABLE 40

Fractional Tumor Volume

| Days P.I. | Fractional tumor volume (V/Vo) Cntrl Avg | St Dev | GLV-1h68 Avg | St Dev | LIVP 1.1.1 Avg | St Dev |
|---|---|---|---|---|---|---|
| −1 | 1 | 0 | 1 | 0 | 1 | 0 |
| 2 | 1.65 | 0.52 | 1.37 | 0.22 | 1.60 | 0.56 |
| 6 | 2.24 | 1.05 | 2.19 | 0.39 | 2.81 | 0.70 |
| 9 | 3.87 | 1.91 | 3.63 | 1.05 | 4.18 | 1.62 |
| 13 | 6.13 | 2.63 | 5.68 | 1.24 | 4.93 | 2.06 |
| 16 | 8.41 | 3.56 | 7.26 | 1.42 | 5.08 | 1.88 |
| 20 | 12.20 | 6.12 | 10.57 | 1.96 | 4.90 | 1.94 |
| 23 | 17.65 | 9.46 | 14.38 | 2.20 | 4.45 | 1.57 |
| 27 | — | — | 17.69 | 4.94 | 3.88 | 1.55 |
| 30 | — | — | — | — | 3.54 | 1.53 |
| 34 | — | — | — | — | 2.91 | 0.96 |
| 37 | — | — | — | — | 2.89 | 0.99 |
| 41 | — | — | — | — | 2.58 | 0.86 |
| 44 | — | — | — | — | 2.40 | 1.10 |
| 48 | — | — | — | — | 2.80 | 1.47 |
| 51 | — | — | — | — | 3.53 | 2.33 |
| 55 | — | — | — | — | 4.53 | 3.43 |

TABLE 41

Net Body Weight

| Days P.I. | Net Body Weight (g) Cntrl | GLV-1h68 | LIVP 1.1.1 |
|---|---|---|---|
| −1 | 28.20 | 27.14 | 26.06 |
| 2 | 28.36 | 26.58 | 26.17 |
| 6 | 29.35 | 27.29 | 26.14 |
| 9 | 29.25 | 26.71 | 24.44 |
| 13 | 28.85 | 26.25 | 24.73 |
| 16 | 27.35 | 26.12 | 25.50 |
| 20 | 27.54 | 25.98 | 27.51 |
| 23 | 27.00 | 25.75 | 27.51 |
| 27 | — | 25.18 | 27.06 |
| 30 | — | — | 28.89 |
| 34 | — | — | 39.37 |
| 37 | — | — | 29.06 |
| 41 | — | — | 28.15 |
| 44 | — | — | 28.59 |
| 48 | — | — | 28.85 |
| 51 | — | — | 28.53 |
| 55 | — | — | 28.37 |

E. Effects of LIVP 1.1.1 in Combination with Pre- and/or Post-Irradiation on U87 Human Glioblastoma Xenografts The in vivo effects of LIVP 1.1.1 were evaluated using a mouse model of human glioma. Experimental details are set forth in Table 42 below. Tumors were established in nude mice by injecting male nude mice (Hsd:Athymic Nude-Foxn1$^{nu}$; Harlan, Indianapolis, Ind.; 4-5 weeks old) subcutaneously (s.c. on the right lateral thigh $5.0\times10^6$ cells in 100 µL PBS) with U-87 MG glioblastoma-astrocytoma cells (ATCC®). Thirteen days following tumor cell implantation, several groups of mice were irradiated at 6 Gy or 3.5 Gy or received no treatment. Fourteen days following tumor cell implantation (tumor size >200 mm$^3$), groups of mice were administered via retro orbital injection $2.0\times10^6$ pfu LIVP isolate 1.1.1 or GLV-1h68 (in 100 µL of PBS) or PBS alone. One day following virus injection several groups of mice were irradiated at 6 Gy or 3.5 Gy or received no treatment. Tumor volume (mm$^3$) was measured at −1, 3, 6, 9, 13, 16, 20, 23, 27, 30, 34, 37, 41 and 44 days post-cancer cell injection. Viral distribution of LIVP 1.1.1 in healthy organs was assessed by measuring viral titer (pfu) at days 3 and 7 post infection.

TABLE 42

Experimental Design

| Group | Day −1 Pre Irradiation | Day 0 Virus | Day +1 Post Irradiation |
|---|---|---|---|
| 1 (n = 14) | None | Buffer | None |
| 2 (n = 19) | None | GLV1h68 | None |
| 3 (n = 19) | None | LIVP 1.1.1 | None |
| 4 (n = 15) | 6 Gy | Buffer | None |
| 5 (n = 19) | 6 Gy | LIVP 1.1.1 | None |
| 6 (n = 19) | None | LIVP 1.1.1 | 6 Gy |
| 7 (n = 9) | 3.5 Gy | Buffer | 3.5 Gy |
| 8 (n = 19) | 3.5 Gy | LIVP 1.1.1 | 3.5 Gy |

The data are set forth in tables 43-50 below. Tables 43 and 44 set forth the median tumor volume and tumor growth, as indicated by fractional tumor volume (V/Vo), for LIVP 1.1.1 and GLV-1h68. Tables 45 and 46 set forth the median tumor volume and tumor growth, as indicated by fractional tumor volume (V/Vo), for LIVP 1.1.1 and 6 Gy radiation. Tables 47 and 48 set forth the median tumor volume and tumor growth, as indicated by fractional tumor volume (V/Vo), for LIVP 1.1.1 and 3.5 Gy radiation. Net body weight is set forth in Table 49. Table 50 sets forth the viral distribution of LIVP 1.1.1 in healthy organs.

LIVP isolate 1.1.1 and GLV-1h68 reduced tumor growth starting 20 days post injection. Treatment with 6 Gy radiation resulted in a slight delay in tumor growth. Treatment 6 Gy radiation either prior to, or after, the administration of LIVP 1.1.1 resulted in a significant decrease in tumor growth. Treatment with two doses of radiation at 3.5 Gy delayed tumor growth for 3 days, but did not inhibit growth. Treatment 3.5 Gy radiation 1 day prior to and 1 day after administration of LIVP 1.1.1 resulted in significant decrease in tumor growth. Net body weight remained steady for all animals.

TABLE 43

Effect of viruses on U-87 tumor cell growth

Median tumor volume (mm$^3$)

| Days P.I. | Cntrl | GLV-1h68 | LIVP 1.1.1 |
|---|---|---|---|
| −1 | 282.62 | 218.20 | 201.54 |
| 3 | 389.25 | 337.59 | 299.00 |
| 6 | 676.87 | 601.70 | 498.08 |
| 9 | 1005.43 | 926.39 | 976.54 |
| 13 | 1454.11 | 1303.12 | 1339.52 |
| 16 | 2099.87 | 1885.29 | 1793.33 |
| 20 | 2477.95 | 1704.78 | 1524.16 |
| 23 | — | 1564.34 | 1060.80 |
| 27 | — | 1601.44 | 896.19 |
| 30 | — | 1277.86 | 496.16 |
| 34 | — | 856.15 | 443.30 |
| 37 | — | 615.19 | 286.49 |
| 41 | — | 650.75 | 340.59 |
| 44 | — | 571.47 | 310.05 |

TABLE 44

Fractional tumor volume

Fractional tumor volume (V/Vo)

| Days P.I. | Cntrl Avg | Cntrl St Dev | GLV-1h68 Avg | GLV-1h68 St Dev | LIVP 1.1.1 Avg | LIVP 1.1.1 St Dev |
|---|---|---|---|---|---|---|
| −1 | 1.00 | 0.00 | 1.00 | 0.00 | 1.00 | 0.00 |
| 3 | 1.43 | 0.10 | 1.44 | 0.13 | 1.60 | 0.24 |
| 6 | 2.29 | 0.31 | 2.78 | 0.52 | 2.70 | 0.63 |
| 9 | 3.85 | 0.58 | 4.41 | 0.77 | 4.58 | 1.09 |
| 13 | 5.93 | 0.93 | 5.99 | 1.24 | 6.31 | 1.80 |
| 16 | 8.60 | 1.08 | 8.53 | 2.44 | 7.94 | 1.74 |
| 20 | 10.36 | 1.84 | 9.38 | 3.84 | 8.59 | 3.38 |
| 23 | — | — | 7.94 | 4.15 | 7.02 | 4.18 |
| 27 | — | — | 8.04 | 4.55 | 6.61 | 4.47 |
| 30 | — | — | 6.83 | 4.16 | 5.76 | 4.99 |
| 34 | — | — | 5.86 | 4.34 | 5.39 | 5.25 |
| 37 | — | — | 5.17 | 4.68 | 5.10 | 5.45 |
| 41 | — | — | 5.43 | 4.68 | 5.19 | 5.40 |
| 44 | — | — | 5.31 | 4.90 | 5.21 | 5.40 |

TABLE 45

Effect of virus and radiation on U-87 tumor cell growth

Median tumor volume (mm$^3$)

| Days P.I. | Cntrl | LIVP 1.1.1 | Pre 6 Gy | Pre 6 Gy + LIVP 1.1.1 | LIVP 1.1.1 + Post 6 Gy |
|---|---|---|---|---|---|
| −1 | 282.62 | 201.54 | 193.94 | 197.06 | 186.81 |
| 3 | 389.25 | 299.00 | 265.61 | 205.24 | 255.55 |
| 6 | 676.87 | 498.08 | 303.60 | 269.70 | 292.92 |
| 9 | 1005.43 | 976.54 | 504.60 | 350.75 | 394.09 |
| 13 | 1454.11 | 1339.52 | 762.78 | 444.94 | 456.80 |
| 16 | 2099.87 | 1793.33 | 987.89 | 435.18 | 513.99 |
| 20 | 2477.95 | 1524.16 | 1422.37 | 381.88 | 450.66 |
| 23 | — | 1060.80 | 1934.53 | 240.03 | 310.46 |
| 27 | — | 896.19 | 2256.58 | 213.44 | 351.07 |
| 30 | — | 496.16 | 2601.16 | 209.38 | 287.27 |
| 34 | — | 443.30 | — | 199.26 | 351.88 |
| 37 | — | 286.49 | — | 156.98 | 229.69 |
| 41 | — | 340.59 | — | 219.40 | 267.09 |
| 44 | — | 310.05 | — | 168.09 | 261.81 |

TABLE 46

Fractional tumor volume

Fractional tumor volume (V/Vo)

| Days P.I. | Cntrl | | LIVP 1.1.1 | | Pre 6 Gy | | Pre 6 Gy + LIVP 1.1.1 | | LIVP 1.1.1 + Post 6 Gy | |
|---|---|---|---|---|---|---|---|---|---|---|
| | Avg | St Dev | Avg | St Dev | Avg | St Dev | Avg | St Dev | Avg | St Dev |
| −1 | 1.00 | 0.00 | 1.00 | 0.00 | 1.00 | 0.00 | 1.00 | 0.00 | 1.00 | 0.00 |
| 3 | 1.43 | 0.10 | 1.60 | 0.24 | 1.29 | 0.40 | 1.12 | 0.17 | 1.46 | 0.43 |
| 6 | 2.29 | 0.31 | 2.70 | 0.63 | 1.38 | 0.32 | 1.36 | 0.31 | 1.69 | 0.46 |
| 9 | 3.85 | 0.58 | 4.58 | 1.09 | 2.48 | 0.46 | 1.98 | 0.82 | 2.20 | 0.37 |
| 13 | 5.93 | 0.93 | 6.31 | 1.80 | 3.50 | 0.71 | 2.23 | 0.87 | 2.77 | 0.62 |
| 16 | 8.60 | 1.08 | 7.94 | 1.74 | 5.37 | 1.94 | 2.64 | 1.68 | 3.03 | 0.87 |
| 20 | 10.36 | 1.84 | 8.59 | 3.38 | 6.95 | 2.98 | 2.35 | 1.97 | 2.89 | 0.96 |
| 23 | — | — | 7.02 | 4.18 | 9.99 | 3.63 | 1.81 | 1.82 | 2.17 | 1.02 |
| 27 | — | — | 6.61 | 4.47 | 11.62 | 3.55 | 1.78 | 1.66 | 2.21 | 1.31 |
| 30 | — | — | 5.76 | 4.99 | 12.91 | 3.58 | 1.57 | 1.46 | 1.91 | 1.08 |
| 34 | — | — | 5.39 | 5.25 | — | — | 1.51 | 1.82 | 1.95 | 0.91 |
| 37 | — | — | 5.10 | 5.45 | — | — | 1.57 | 1.93 | 1.52 | 0.79 |
| 41 | — | — | 5.19 | 5.40 | — | — | 1.66 | 2.10 | 1.76 | 1.08 |
| 44 | — | — | 5.21 | 5.40 | — | — | 1.65 | 2.10 | 2.03 | 1.91 |

TABLE 47

Effect of virus and radiation on U-87 tumor cell growth

| Days P.I. | Median tumor volume (mm³) | | | |
|---|---|---|---|---|
| | Cntrl | LIVP 1.1.1 | 2 × 3.5 Gy | 2 × 3.5 Gy + LIVP 1.1.1 |
| −1 | 282.62 | 201.54 | 119.95 | 206.39 |
| 3 | 389.25 | 299.00 | 200.08 | 196.47 |
| 6 | 676.87 | 498.08 | 164.22 | 286.70 |
| 9 | 1005.43 | 976.54 | 246.96 | 305.94 |
| 13 | 1454.11 | 1339.52 | 437.06 | 321.30 |
| 16 | 2099.87 | 1793.33 | 610.43 | 346.08 |
| 20 | 2477.95 | 1524.16 | 957.34 | 366.04 |
| 23 | — | 1060.80 | 1153.35 | 246.24 |
| 27 | — | 896.19 | 1428.65 | 243.84 |
| 30 | — | 496.16 | 2032.37 | 189.22 |
| 34 | — | 443.30 | — | 189.00 |
| 37 | — | 286.49 | — | 210.47 |
| 41 | — | 340.59 | — | 171.00 |
| 44 | — | 310.05 | — | 153.12 |

TABLE 48

Fractional tumor volume

Fractional tumor volume (V/Vo)

| Days P.I. | Cntrl | | LIVP 1.1.1 | | 2 × 3.5 Gy | | 2 × 3.5 Gy + LIVP 1.1.1 | |
|---|---|---|---|---|---|---|---|---|
| | Avg | St Dev | Avg | St Dev | Avg | St Dev | Avg | St Dev |
| −1 | 1.00 | 0.00 | 1.00 | 0.00 | 1.00 | 0.00 | 1.00 | 0.00 |
| 3 | 1.43 | 0.10 | 1.60 | 0.24 | 1.34 | 0.20 | 1.01 | 0.28 |
| 6 | 2.29 | 0.31 | 2.70 | 0.63 | 1.32 | 0.13 | 1.34 | 0.39 |
| 9 | 3.85 | 0.58 | 4.58 | 1.09 | 1.88 | 0.18 | 1.64 | 0.47 |
| 13 | 5.93 | 0.93 | 6.31 | 1.80 | 3.20 | 0.42 | 1.88 | 0.44 |
| 16 | 8.60 | 1.08 | 7.94 | 1.74 | 5.21 | 0.37 | 2.27 | 1.11 |
| 20 | 10.36 | 1.84 | 8.59 | 3.38 | 7.38 | 1.90 | 2.32 | 2.24 |
| 23 | — | — | 7.02 | 4.18 | 9.95 | 0.47 | 2.72 | 4.44 |
| 27 | — | — | 6.61 | 4.47 | 11.93 | 0.95 | 2.95 | 5.32 |
| 30 | — | — | 5.76 | 4.99 | 14.31 | 1.38 | 2.83 | 5.37 |
| 34 | — | — | 5.39 | 5.25 | — | — | 2.79 | 5.39 |
| 37 | — | — | 5.10 | 5.45 | — | — | 2.70 | 5.43 |
| 41 | — | — | 5.19 | 5.40 | — | — | 2.69 | 5.43 |
| 44 | — | — | 5.21 | 5.40 | — | — | 2.65 | 5.45 |

TABLE 49

Net Body Weight

Net Body Weight (g)

| Days P.I. | Cntrl | GLV-1h68 | LIVP 1.1.1 | Pre 6 Gy | Pre 6 Gy + LIVP 1.1.1 | LIVP 1.1.1 + Post 6 Gy | 2 × 3.5 Gy | 2 × 3.5 Gy + LIVP 1.1.1 |
|---|---|---|---|---|---|---|---|---|
| −1 | 27.94 | 29.49 | 28.90 | 27.27 | 30.14 | 28.02 | 28.48 | 29.26 |
| 6 | 28.45 | 28.63 | 28.52 | 28.28 | 30.84 | 25.58 | 26.72 | 28.33 |
| 12 | 28.27 | 28.98 | 26.82 | 28.74 | 32.37 | 26.76 | 28.81 | 29.16 |
| 19 | 27.26 | 28.93 | 26.80 | 27.83 | 30.81 | 28.25 | 28.53 | 30.16 |
| 26 | — | 29.47 | 29.59 | 26.88 | 33.21 | 27.13 | 27.05 | 29.32 |
| 33 | — | 29.88 | 29.77 | — | 32.72 | 26.36 | — | 27.84 |
| 40 | — | 28.98 | 28.69 | — | 31.34 | 26.18 | — | 26.53 |

TABLE 50

Viral distribution of LIVP 1.1.1 in healthy organs at days 3 and 7 post infection

|  | pfu/liver | pfu/lungs | pfu/spleen | pfu/brain |
|---|---|---|---|---|
| Day 3 | | | | |
| Cntrl | 0 | 0 | 0 | 0 |
| GLV-1h68 | 0 | 0 | 0 | 0 |
| LIVP 1.1.1 | 0 | 0 | 0 | 0 |
| Pre 6 Gy | 0 | 0 | 0 | 0 |
| Pre 6 Gy + LIVP 1.1.1 | 0 | 0 | 0 | 10.6 ± 30.1 |
| LIVP 1.1.1 + Post 6 Gy | 0 | 0 | 0 | 0 |
| 2 × 3.5 Gy | 0 | 0 | 0 | 0 |
| 2 × 3.5 Gy + LIVP 1.1.1 | 0 | 59.5 ± 168 | 0 | 0 |
| Day 7 | | | | |
| Cntrl | 0 | 0 | 0 | 0 |
| GLV-1h68 | 0 | 0 | 8.5 ± 24.0 | 0 |
| LIVP 1.1.1 | 0 | 0 | 54.4 ± 130 | 0 |
| Pre 6 Gy | 0 | 0 | 0 | 0 |
| Pre 6 Gy + LIVP 1.1.1 | 0 | 126 ± 355 | 8.38 ± 23.7 | 0 |
| LIVP 1.1.1 + Post 6 Gy | 0 | 0 | 0 | 0 |
| 2 × 3.5 Gy | 0 | 0 | 0 | 0 |
| 2 × 3.5 Gy + LIVP 1.1.1 | 0 | 0 | 0 | 0 |

F. Effects of LIVP 1.1.1 in Combination with Pre-Irradiation on Mouse Melanoma Allografts The in vivo effects of LIVP 1.1.1 were evaluated using an allograft mouse model of melanoma. Experimental details are set forth in Table 51 below. Tumors were established in C57BL/6 mice by injecting B16-F10 mouse melanoma cells (ATCC®) subcutaneously (s.c. on the right lateral thigh $2.0 \times 10^5$ cells in 100 μL PBS) into female mice (Harlan). Thirteen days following tumor cell implantation, several groups of mice were irradiated at 6 Gy or 4 Gy or received no treatment. Fourteen days following tumor cell implantation (tumor size >200 mm$^3$), groups of mice were administered via retro orbital injection $5.0 \times 10^7$ pfu LIVP isolate 1.1.1 or GLV-1h68 (in 100 μL of PBS) or PBS alone. Several groups of mice received an additional 4 Gy dosage of radiation at 1, 6 and 8 days following virus injection or received no treatment. Tumor volume (mm$^3$) was measured at −1, 2, 6, 8, 13, 16 and 20 days post-cancer cell injection.

TABLE 51

Experimental Design

| Group | Day −1 Pre Irradiation | Day 0 Virus | Day +1 Post Irradiation | Day +6 Post Irradiation | Day +8 Post Irradiation |
|---|---|---|---|---|---|
| 1 (n = 8) | None | Buffer | None | None | None |
| 2 (n = 8) | None | LIVP 1.1.1 | None | None | None |
| 3 (n = 8) | 6 Gy | Buffer | None | None | None |
| 4 (n = 8) | 6 Gy | LIVP 1.1.1 | None | None | None |
| 5 (n = 8) | 4 Gy | Buffer | 4 Gy | 4 Gy | 4 Gy |
| 6 (n = 8) | 4 Gy | LIVP 1.1.1 | 4 Gy | 4 Gy | 4 Gy |

Results of average tumor volume are provided in Table 52. Fractional tumor volume (V/Vo) are set forth in Table 53. Table 54 sets forth the mean time for the tumor to reach a fractional tumor volume of 50 (FTV of 50). A FTV of 50 corresponds to a tumor volume between 3750 mm$^3$ and 5000 mm$^3$, an endpoint at which mice must be removed from the experiment. Treatment with LIVP 1.1.1 resulted in a slight decrease in tumor volume in the B16-F10 tumor cells. Treatment with 6 Gy radiation and LIVP 1.1.1 was similar to treatment with only 6 Gy radiation, and resulted in approximately 7 day delay in the time to reach a fractional tumor volume of 50. Treatment with four doses of 4 Gy radiation and LIVP 1.1.1 reduced tumor volume and delayed the mean time to reach a FTV of 50 to 14 days.

TABLE 52

Effect of LIVP 1.1.1 and radiation on B16-F10 tumor cell growth

Average tumor volume (mm$^3$)

| Days P.I. | Cntrl | LIVP 1.1.1 | Pre 6 Gy | Pre 6 Gy + LIVP 1.1.1 | 4 × 4 Gy | 4 × 4 Gy + LIVP 1.1.1 |
|---|---|---|---|---|---|---|
| −1 | 115.97 | 82.94 | 100.82 | 87.88 | 85.25 | 91.30 |
| 2 | 428.15 | 276.92 | 235.30 | 197.59 | 215.81 | 233.50 |
| 6 | 2011.62 | 1257.80 | 579.50 | 508.44 | 767.77 | 590.66 |
| 9 | 3885.49 | 2828.71 | 1138.79 | 1018.95 | 1143.95 | 724.69 |
| 13 | — | — | 2116.73 | 2409.16 | 1568.72 | 963.13 |
| 16 | — | — | 3774.90 | 4145.31 | 2183.43 | 1326.86 |
| 20 | — | — | — | — | 3595.91 | 2636.58 |

TABLE 53

Fractional tumor volume

Fractional tumor volume (V/Vo)

| Days P.I. | Cntrl | | LIVP 1.1.1 | | Pre 6 Gy | | Pre 6 Gy + LIVP 1.1.1 | | 4 × 4 Gy | | 4 × 4 Gy + LIVP 1.1.1 | |
|---|---|---|---|---|---|---|---|---|---|---|---|---|
| | Avg | St Dev | Avg | St Dev | Avg | St Dev | Avg | St Dev | Avg | St Dev | Avg | St Dev |
| −1 | 1.00 | 0.00 | 1.00 | 0.00 | 1.00 | 0.00 | 1.00 | 0.00 | 1.00 | 0.00 | 1.00 | 0.00 |
| 2 | 4.51 | 3.00 | 3.91 | 1.44 | 2.80 | 1.51 | 2.73 | 1.84 | 3.06 | 1.55 | 2.54 | 0.49 |
| 6 | 23.91 | 19.51 | 17.87 | 10.58 | 6.61 | 4.08 | 63.87 | 4.41 | 9.64 | 4.53 | 6.21 | 2.12 |
| 9 | 49.81 | 45.78 | 45.66 | 29.80 | 12.69 | 7.98 | 14.75 | 12.52 | 16.61 | 10.60 | 7.45 | 2.60 |
| 13 | — | — | — | — | 22.76 | 11.41 | 35.81 | 30.67 | 21.90 | 12.78 | 10.68 | 4.81 |
| 16 | — | — | — | — | 50.15 | 40.13 | 64.76 | 63.82 | 34.77 | 28.41 | 14.93 | 4.67 |
| 20 | — | — | — | — | — | — | — | — | 51.32 | 31.32 | 30.70 | 11.44 |

TABLE 54

Mean time for tumor to reach fractional tumor volume of 50

| Group | Days to FTV = 50 | Time delay (days) |
|---|---|---|
| Cntrl | 8.40 | — |
| LIVP 1.1.1 | 8.94 | 0.54 |
| Pre 6 Gy | 15.76 | 7.36 |
| Pre 6 Gy + LIVP 1.1.1 | 14.41 | 6.01 |
| 4 × 4 Gy | 17.17 | 8.77 |
| 4 × 5 Gy + LIVP 1.1.1 | 22.37 | 13.97 |

G. Effects of LIVP 5.1.1 on A549 Human Lung Carcinoma Xenografts

The in vivo effects of LIVP 5.1.1 was further evaluated using a mouse model of human lung cancer. Tumors were established in nude mice by injecting A549 cells (ATCC®) subcutaneously (s.c. on the right lateral thigh $5.0 \times 10^6$ cells in 100 μL PBS) into female nude mice (Hsd:Athymic Nude-Foxn1$^{nu}$; Harlan, Indianapolis, Ind.; 6-8 weeks old). Seventeen days following tumor cell implantation (tumor size >250 mm$^3$), groups of mice were administered via retro-orbital injection with $5.0 \times 10^6$ pfu LIVP 5.1.1, GLV-1h68 (in 100 μL of PBS), LIVP 1.1.1+2.5 μM ST-246, GLV-1h68+2.5 μM ST-246 or PBS alone. Tumor volume (mm$^3$) was measured twice a week post-cancer cell injection. Mice were sacrificed 42 days post implantation and viral titers were determined in tumors and organs using standard techniques.

Results of median tumor volume are provided in Table 55. Average body weight is set forth in Table 56. Viral titers in tumors and organs are set forth in Table 57 below, which lists the viral titer in pfu/gram tissue for tumor, liver, spleen, kidneys, heart, lung, serum and brain. All virus-treated mice showed a significant tumor reduction compared to the PBS controls. Tumor regression of LIVP 5.1.1 injected animals was somewhat increased as compared to GLV-1h68. The addition of 2.5 μM ST-246, an antiviral agent, in addition to LIVP 5.1.1 or GLV-1h68 decreased the ability of each virus to reduce tumor size, but tumor reduction was greater than treatment with PBS alone. GLV-1h68 was slightly toxic towards the mice, as evidenced by a decrease in average body weight. The addition of $^{ST}$-246 reduced toxicity in mice treated with GLV-1h68. GLV-1h68 and LIVP isolate 5.1.1 were identified primarily in the tumor tissue, with the brain and the liver also containing viral particles.

TABLE 55

Effect of viruses on A549 tumor cell growth

| | Median tumor volume (mm$^3$) | | | | |
|---|---|---|---|---|---|
| Days P.I. | Cntrl | GLV-1h68 | GLV-1h68 + ST-246 | LIVP 5.1.1 | LIVP 5.1.1 + ST-246 |
| 0 | 300.76 | 212.85 | 260.87 | 248.78 | 237.46 |
| 3 | 380.01 | 268.56 | 348.60 | 322.92 | 317.19 |
| 6 | 556.31 | 410.55 | 449.24 | 463.79 | 438.08 |
| 10 | 828.03 | 570.49 | 665.71 | 652.10 | 670.91 |
| 13 | 1029.32 | 631.23 | 860.09 | 720.54 | 930.68 |
| 17 | 1168.51 | 753.82 | 1270.42 | 855.82 | 1092.80 |
| 24 | 1849.77 | 779.68 | 2035.14 | 761.49 | 1690.93 |
| 27 | 1952.72 | 653.42 | 2641.25 | 672.55 | 1757.43 |
| 31 | 2261.62 | 593.72 | 2616.03 | 491.55 | 1660.64 |
| 34 | 2402.29 | 526.83 | 2277.73 | 428.70 | 1295.18 |
| 38 | 2876.76 | 452.59 | 2081.42 | 381.56 | 1169.51 |
| 42 | 3201.92 | 364.17 | 1725.74 | 315.42 | 1014.24 |

TABLE 56

Average Body Weight

| | Average body weight (g) | | | | |
|---|---|---|---|---|---|
| Days P.I. | Cntrl | GLV-1h68 | GLV-1h68 + ST-246 | LIVP 5.1.1 | LIVP 5.1.1 + ST-246 |
| 0 | 23.80 | 23.43 | 24.38 | 24.45 | 23.60 |
| 3 | 24.28 | 22.68 | 23.90 | 23.90 | 22.98 |
| 6 | 24.33 | 23.88 | 24.10 | 23.85 | 23.60 |
| 10 | 24.90 | 23.80 | 23.75 | 24.20 | 23.45 |
| 13 | 25.05 | 24.60 | 24.95 | 24.50 | 23.93 |
| 17 | 26.58 | 24.18 | 25.43 | 25.13 | 24.15 |
| 24 | 27.13 | 21.93 | 26.75 | 26.00 | 25.35 |
| 27 | 27.55 | 21.78 | 27.38 | 25.90 | 25.15 |
| 31 | 28.15 | 21.88 | 27.80 | 26.35 | 26.38 |
| 34 | 29.18 | 21.93 | 27.60 | 26.40 | 26.25 |
| 38 | 29.95 | 21.85 | 27.40 | 25.60 | 25.90 |
| 42 | 29.98 | 21.28 | 27.63 | 26.95 | 26.25 |

TABLE 57

Viral titers in tumors and organs (pfu/g tissue)

| | GLV-1h68 | | GLV-1h68 + ST-246 | | LIVP 5.1.1 | | LIVP 5.1.1 + ST-246 | |
|---|---|---|---|---|---|---|---|---|
| | Avg. | St. Dev. | Avg. | St. Dev. | Avg. | St. Dev. | Avg. | St. Dev. |
| tumor | 1.33E+08 | 6.65E+07 | 1.02E+08 | 3.39E+07 | 9.50E+07 | 4.67E+07 | 2.10E+08 | 1.30E+08 |
| liver | 53.33 | 61.10 | 10.00 | 20.00 | 10.00 | 20.00 | 300.00 | 120.00 |
| spleen | 0.00 | 0.00 | 0.00 | 0.00 | 0.00 | 0.00 | 70.00 | 140.00 |
| kidneys | 0.00 | 0.00 | 0.00 | 0.00 | 0.00 | 0.00 | 0.00 | 0.00 |
| heart | 0.00 | 0.00 | 10.00 | 20.00 | 0.00 | 0.00 | 0.00 | 0.00 |
| lung | 0.00 | 0.00 | 0.00 | 0.00 | 0.00 | 0.00 | 8500.00 | 17000.00 |
| serum | 0.00 | 0.00 | 0.00 | 0.00 | 0.00 | 0.00 | 0.00 | 0.00 |
| brain | 133.33 | 230.94 | 410.00 | 451.81 | 140.00 | 280.00 | 260.00 | 337.05 |

Example 8

Imaging of LIVP 5.1.1 and GLV-1H68 in A549 Cells and Tumors

A. Plaque Morphology in A459 Lung Carcinoma Cells

Plaque morphology in A549 lung carcinoma cells was determined by staining with an antibody against vaccinia and Hoechst. Human A549 lung carcinoma cells were cultivated in RPMI-1640 Media containing 10% FCS and 1% Penicillin/Streptomycin. The A549 cells were seeded on cover slips in 24-well plates. At a confluence of 100%, cells were infected with 50 pfu/well of GLV-1h68 or LIVP isolate 5.1.1. Three days post infection (dpi), cells were fixed with 500 µL 4% PFA for 10 min and washed 3 times with 1×PBS. For blocking and permeabilization, the cells were incubated for 15 min with 5004 blocking solution (lx PBS/5% FCS/ 0.1% Triton™-X 100) per well. Rabbit polyclonal antibody to vaccinia virus (diluted 1:500 in blocking solution, (ab35219, Abcam®)) was added and the cells were incubated overnight at 4° C. on a shaker. Subsequently, the plates were washed 3 times with 1×PBS. For blocking and permeabilization, the cells were incubated for 15 min with 5004 1×PBS/5% FCS/0.1% Triton™-X 100 per well. Secondary antibody (Cy2-conjugated AffiniPure Donkey Anti-Rabbit IgG, diluted 1:200 in blocking solution (711-225-152, Jackson ImmunoResearch) and Hoechst (Hoechst 33258 diluted 1:400 (861405, Sigma Aldrich)) were added and incubated for 45 minutes. Finally, the cells were washed 3 times with 1×PBS and coverslips were embedded on the plates. The results show an increased plaque size in LIVP 5.1.1 infected cells compared to GLV-1h68 infected cells.

B. Immunofluorescence Staining of A549 Tumors

Tumors were established in nude mice by injecting A549 cells (ATCC®) subcutaneously (s.c. on the right lateral thigh 5.0×10$^6$ cells in 100 µL PBS) into female nude mice (Hsd: Athymic Nude-Foxn1$^{nu}$; Harlan, Indianapolis, Ind.; 6-8 weeks old). Seventeen (17) days following tumor cell implantation (tumor size >250 mm$^3$), mice were administered via tail-vein injection 5.0×10$^6$ pfu LIVP 5.1.1, GLV-1h68 (in 100 µl of PBS) or PBS alone. Mice were sacrificed 42 days post implantation and tumors were harvested and frozen. Frozen tumors were fixed overnight in 4% PFA at 4° C. on a shaker. The tumors were then washed 5 times for 30 min with 1×PBS. Tumors were halved and embedded with 5% low melting point agarose in 1×PBS into 6-well plates. Agarose sections (100 gm) were prepared with a vibratome and direct transferred into 48-well plates with 1×PBS. For the staining, sections were blocked and permeabilized for 1 h with 500 µL blocking solution (1×PBS/0.2% Triton™-X 100/5% FCS) per well. Primary antibodies were incubated overnight at room temperature on a shaker. Primary antibodies included a rabbit polyclonal antibody to vaccinia virus (diluted 1:100 in blocking solution, (ab35219, Abcam®)) and a rat anti-mouse MHC Class II antibody (diluted 1:200 in blocking solution, (14-5321-85, eBioscience)). Following washing 3 times with 1×PBS, secondary antibodies and Hoechst 33258 (diluted 1:400 in blocking solution) were added and incubated for 4 hours at room temperature on a shaker. Secondary antibodies include Cy2-conjugated AffiniPure Donkey Anti-Rabbit IgG (diluted 1:200 in blocking solution (711-225-152, Jackson ImmunoResearch)), Cy3-conjugated AffiniPure Donkey Anti-Rat IgG (diluted 1:200 in blocking solution (712-165-153, Jackson ImmunoResearch)). The tumors were washed 3 times with 1×PBS and embedded in Mowiol®. The results showed no significant difference in viral spreading or immune cell attraction or localization between GLV-1h68 and LIVP 5.1.1 infected tumors.

Example 9

Effects of LIVP 1.1.1 on Canine Soft Tissue Sarcoma in a Xenograft Mouse Model In this example, the therapeutic effects of LIVP 1.1.1 and GLV-1h68 were examined in canine soft tissue sarcoma in a xenograft mouse model.

A. Materials and Methods

1. Cell Culture

African green monkey kidney fibroblasts (CV-1) were obtained from the American Type Culture Collection (ATCC®). Morris (MTH52c) is derived from a soft tissue sarcoma [Any MacNeill, unpublished data]. Cells were cultured in DMEM supplemented with antibiotic-solution (100 U/ml penicillin G, 100 units/ml streptomycin) and 10% fetal bovine serum (FBS; Invitrogen™ GmbH, Karlsruhe, Germany) for CV-1 and 20% FBS for MTH52c at 37° C. under 5% $CO_2$.

2. Virus Strains

GLV-1h68 and LIVP 1.1.1 vaccinia strain were employed for this study and are described in Example 1.

3. Cell Viability Assay

Cells were seeded in 24-well plates (Nunc™, Wiesbaden, Germany). After 24 h in culture, cells were infected with LIVP 1.1.1 and GLV-1h68, using multiplicities of infection (MOI) of 0.1 and 1.0. The cells were incubated at 37° C. for 1 h, the infection medium was removed and subsequently the cells were incubated in fresh growth medium. The amount of viable cells after infection was measured using 3-(4,5-dimethylthiazol-2-yl)-2,5-diphenyltetrazolium bromide (MTT) (Sigma, Taufkirchen, Germany). At 24, 48, 72, or 96 hours post infection, medium was replaced by 0.5 ml MTT solution at a concentration of 2.5 mg/ml MTT dissolved in RPMI 1640 without phenol red and incubated for 2 h at 37° C. in a 5% CO2 atmosphere. After removal of the MTT solution, the color reaction was stopped by adding 1 N HCl diluted in isopropanol. The optical density was measured at a wavelength of 570 nm. Uninfected cells were used as reference and were considered as 100% viable.

4. In Vitro Viral Replication

For the viral replication assay, cells grown in 24-well plates were infected with LIVP 1.1.1 and GLV-1h68 at a MOI of 0.1. After one hour of incubation at 37° C. with gentle agitation every 20 min, the infection medium was removed and replaced by a fresh growth medium. After 1, 6, 12, 24, 48, 72 and 96 hours, the cells and supernatants were harvested. Following three freeze-thaw cycles, serial dilutions of the lysates were titered by standard plaque assays on CV-1 cells. All samples were measured in triplicate.

5. Western Blot Analysis

Three days prior to infection, Morris cells were seeded in 24-well plates (Nunc™, Wiesbaden, Germany). If not otherwise indicated, the 90% confluent cell layer was mock-infected or infected with LIVP 1.1.1 or GLV-1h68 at a MOI of 1.0 for 1 h at 37° C. The virus-containing medium was aspirated and replaced by fresh medium containing 20% FBS. For protein isolation and detection, cells were harvested and resuspended in sodium dodecyl sulfate (SDS) sample buffer at one, 12, 24, 48, 72 and 96 hours post-infection (hpi). The protein samples were separated by 10% SDS polyacrylamide gel electrophoresis (PAGE) and subsequently blotted onto a nitrocellulose membrane (Whatman® GmbH, Dassel, Germany). The membrane was then incubated with anti-beta actin mouse monoclonal antibodies (ab6276, Abcam®, Cambridge, UK) or polyclonal rabbit anti-vaccinia virus (anti-VACV) antibody (Abcam®, Cambridge, UK), and detection was obtained using horseradish peroxidase labeled secondary antibodies against mice (ab6728, Abcam®, Cambridge, UK) or rabbits (ab6721, Abcam®, Cambridge, UK) followed by enhanced chemiluminescence.

6. Fluorescence Imaging

The GFP signals of virus-infected cells and animals were analyzed with a fluorescence microscope (Leica DM IRB; Wetzlar, Germany) and a fluorescence stereomicroscope (Leica MZ 16 FA; Wetzlar, Germany), respectively. Images were captured with an electronic camera and were processed using MetaMorph® (Universal Imaging; Downingtown, Pa., USA) and Photoshop® 7.0 (Adobe Systems, Mountain View, Calif., USA).

7. Vaccinia Virus-Mediated Therapy of Morris Xenografts

Tumors were generated by implanting $1 \times 10^6$ cells in 100 µl PBS subcutaneously into the right hind leg of 6- to 8-week-old female nude mice (NCI/Hsd/Athymic Nude-Foxnlnu, Harlan Winkelmann GmbH, Borchen, Germany). Tumor growth was monitored weekly in two dimensions using a digital caliper. Tumor volume was calculated as [(length×width2)/2]. On day 28, a single dose of LIVP1.1.1 or GLV-1h68 virus ($1 \times 10^7$ plaque forming units [pfu] in 100 µl PBS) was injected into the tail vein (i.v.). The control animals were injected i.v. with PBS only.

The significance of the results was calculated by two-way analysis of variance (ANOVA) using the GraphPad Prism® software (San Diego, USA). Results are displayed as means±s.d. (standard deviation). P values of <0.05 were considered significant.

The animals were euthanized by cervical dislocation. All animal experiments were approved by the government of Unterfranken and conducted according to the German animal protection guidelines.

B. Results

1. Cytotoxicity of LIVP 1.1.1 and GLV-1h68 Against Canine Sarcoma Cells in Culture Morris cells were seeded three days prior to infection in 24-well plates. Cells were then infected with either LIVP 1.1.1 or GLV-1h68 using MOIs of 1.0 and 0.1, respectively. Cell viability was analyzed at 24, 48, 72 and 96 hours post infection (hpi) by MTT-assays as described in Section A. The results are shown in Table 58. Values are presented as percentages of respective uninfected controls.

Ninety-six hours after virus GLV-1h68 infection at MOIs of 0.1 and 1.0, only 19.1% and 13.13% Morris cells survived the treatment. After LIVP 1.1.1 infection only 10.1% and 5.1% living Morris cells at the some time point and MOIs. These results show that LIVP1.1.1 virus infection compared to GLV-1h68 leads to a slightly more efficient eradication of the canine sarcoma cells in culture.

TABLE 58

Cytotoxicity of LIVP 1.1.1 and GLV-1h68 in Morris canine sarcoma cells

| h.p.i. | GLV-1h68 MOI 0.1 (% rel. survival) | | GLV-1h68 MOI 1.0 (% rel. survival) | | LIVP 1.1.1 MOI 0.1 (% rel. survival) | | LIVP 1.1.1 MOI 1.0 (% rel. survival) | |
|---|---|---|---|---|---|---|---|---|
| | Average | Std Dev | Average | Std Dev | Average | Std Dev | Average | Std Dev |
| 24 | 85.99 | 2.70 | 68.15 | 6.76 | 89.98 | 0.90 | 84.65 | 7.69 |
| 48 | 59.13 | 9.22 | 33.91 | 9.22 | 68.18 | 3.47 | 59.82 | 6.17 |
| 72 | 33.11 | 5.73 | 18.24 | 1.43 | 33.43 | 4.51 | 16.41 | 7.74 |
| 96 | 19.19 | 5.25 | 13.13 | 3.03 | 10.14 | 1.38 | 5.07 | 6.23 |

2. Replication Efficacy of LIVP 1.1.1 or GLV-1h68 in Morris Cells.

"Morris" cells were infected with LIVP 1.1.1 or GLV-1h68 at a MOI of 0.1 as described above. Viral titers were determined at different time points during the course of infection as pfu per well in triplicate by standard plaque assay in CV-1 cell monolayers. The results are presented in Table 59.

The maximum viral titers were observed at 96 hpi for LIVP 1.1.1 ($2.14 \times 10^7 +/- 5.3 \times 10^6$ pfu/well) and GLV-1h68 ($2.39 \times 10^6 +/- 7.4 \times 10^5$ pfu/well). These data correlated very well with cell death and demonstrated that LIVP 1.1.1 replicated more efficiently than GLV-1h68 in Morris cells under these experimental conditions.

TABLE 59

Viral titer of LIVP 1.1.1 and GLV-1h68 in Morris canine sarcoma cells

| hpi | 1h68 | | LIVP 1.1.1 | |
|---|---|---|---|---|
| | Average | Std Dev | Average | Std Dev |
| 1 | 4.36E+02 | 2.06E+02 | 3.07E+03 | 1.96E+03 |
| 6 | 4.42E+02 | 2.32E+02 | 2.54E+03 | 7.57E+02 |
| 12 | 2.24E+03 | 2.61E+02 | 2.22E+04 | 7.78E+02 |
| 24 | 7.56E+04 | 1.54E+04 | 4.84E+05 | 1.97E+05 |
| 48 | 3.60E+05 | 1.20E+05 | 3.20E+06 | 8.56E+05 |
| 72 | 6.38E+05 | 4.29E+05 | 1.70E+07 | 4.24E+06 |
| 96 | 1.51E+06 | 3.36E+05 | 2.14E+07 | 5.34E+06 |

3. Analysis of the Effects of LIVP 1.1.1 or Glv-1H68 Infection on Morris Cells by Microscopy The efficacy of LIVP 1.1.1- or GLV-1h68-infection on Morris cells was also analyzed by fluorescence microscopy at MOIs of 0.1 and 1.0, respectively. For this purpose, during the course of infection, virus-treated Morris cells were visualized by Hoechst-12222 staining (blue, for nuclei) or propidium iodide staining (red, for dead cells) and were analyzed at different time points (1, 24, 48, 72 and 96 hpi) using the fluorescence microscope Leica DM IRB. Images were then merged to indicate the degree of infection and lysis of cells. In the case of GLV-1h68-infection the expression of the recombinant viral marker gene GFP (green fluorescing protein) was analyzed in addition.

In these experimental settings, Morris cells infected with GLV-1h68 at MOI of 0.1 and 1.0 exhibited the strongest GFP expression at 48 and 72 h. In addition, using dead-cell specific propidium iodide (PI) staining, it was also found that most of the infected cells were PI-positive at 96 hpi. These data correlated very well with the data of our cell viability assay. Pictures were taken at different time points post infection with the digital camera of a Leica DM IRB fluorescence microscope and merged to show the amount of dead cells obverse to all cells. Analysis of the LIVP 1.1.1 infection on Morris cells demonstrated that LIVP 1.1.1 treatment led to a significantly higher death rate in Morris cells compared to uninfected cells.

4. Western Blot Analysis of Virus-Mediated Protein Expression in Morris Cells after Infection with LIVP 1.1.1 or GLV-1h68

Cells were seeded in 24-well plates and grown until they reached 90% confluence. Cells were then infected with LIVP 1.1.1 or GLV-1h68 at a MOI of 1.0 for 1 h at 37° C. Supernatants were aspirated and replaced by fresh growth Medium for Morris cells. For protein isolation and detection, cells were harvested at different time-points (1, 24, 48, 72 and 96 hpi) and resuspended in sodium dodecyl sulfate (SDS) buffer. Samples were treated with Benzonase for 30 min at 37° C. The protein samples were separated by 10% SDS polyacryl-amide gel electrophoresis (PAGE) and subsequently blotted onto a nitrocellulose membrane. The membrane was then incubated with anti-beta actin mouse monoclonal antibodies (1:10,000), or anti-Vaccinia virus rabbit polyclonal antibodies (1:1000) and detected using horseradish peroxidase labeled secondary antibodies against mouse (1:2,000) or rabbit (1:10,000) followed by enhanced chemiluminescence. Western blot analysis also confirmed a more efficient replication of LIVP 1.1.1 compared to GLV-1h68 in Morris cells as indicated by a stronger signal of Vaccinia virus antibodies in LIVP 1.1.1-infected samples.

5. Systemic Treatment of Morris Xenografts with GLV-1h68 and LIVP 1.1.1

Twelve female athymic nude FoxN1 mice at an age of 6-8 weeks were implanted with $1\times10^6$ Morris cells. Four weeks post implantation, all nude mice developed tumors with volumes around 700 to 1100 mm³. Animals were separated into three groups (n=4) and injected with GLV-1h68, LIPV1.1.1 or PBS (control) respectively. Tumor size was measured weekly.

Up to day 21 post infection, all mice of the control group developed tumors with volumes greater than 3000 mm³ and therefore the study terminated with this group. In contrast, all virus-treated mice showed a significant tumor reduction compared to the controls at this time point. The results are presented in Table 60.

Virus injection caused a significant tumor regression in all LIVP 1.1.1 treated mice. This was not the case for the GLV-1h68-treated group, where two of four mice developed tumors with volume greater than 3000 mm³ at 35 dpi. This data suggests that LIVP 1.1.1 has a higher oncolytic potential than GLV-1h68 in Morris xenografts.

TABLE 60

Effect of LIVP 1.1.1 and GLV-1h48 on Morris tumor cell growth

| Days | Median tumor volume (mm³) | | |
|---|---|---|---|
| P.I. | Cntrl | GLV-1h68 | LIVP 1.1.1 |
| 0 | 984.00 | 1125.00 | 666.00 |
| 7 | 1956.30 | 1557.00 | 1268.00 |
| 14 | 3044.60 | 2150.00 | 1242.00 |
| 70 | 3470.40 | 1256.00 | 426.18 |
| 28 | — | 1711.00 | 462.00 |

TABLE 60-continued

Effect of LIVP 1.1.1 and GLV-1h48 on Morris tumor cell growth

| Days | Median tumor volume (mm³) | | |
|---|---|---|---|
| P.I. | Cntrl | GLV-1h68 | LIVP 1.1.1 |
| 35 | — | 3063.00 | 302.30 |
| 42 | — | — | 120.84 |

— = mice were killed due to tumor size greater than 3000 mm³

TABLE 61

Average Body Weight

| Days | Average weight (g) | | |
|---|---|---|---|
| P.I. | Cntrl | GLV-1h68 | LIVP 1.1.1 |
| 0 | 27.23 | 23.69 | 25.55 |
| 7 | 29.15 | 26.00 | 23.65 |
| 14 | 29.93 | 25.03 | 24.68 |
| 20 | 31.48 | 26.23 | 26.23 |
| 28 | — | 25.98 | 26.18 |
| 35 | — | 24.88 | 25.30 |
| 42 | — | — | 25.10 |

It was found that there was a significant improvement in survival of LIVP 1.1.1 injected mice compared to the control groups of mice. No death was observed in the LIVP 1.1.1 injected mice until day 39 and the last mouse died at day 105. By comparison, the control mice that did not receive LIVP 1.1.1 treatment were euthanized at days 17 and 24 due to tumor sizes greater than 3000 mm³, which severely impacted the overall health of the mice. These results are presented in Table 62.

TABLE 62

Survival

| Days | Survival Rate (%) | |
|---|---|---|
| P.I. | Cntrl | LIVP 1.1.1 |
| 0 | 100 | 100 |
| 17 | 80* | 100 |
| 24 | 0* | 100 |
| 39 | 0 | 80 |
| 48 | 0 | 60 |
| 58 | 0 | 40 |
| 98 | 0 | 20 |
| 105 | 0 | 0 |

*= mice killed due to tumor size greater than 3000 mm³

Example 10

Analysis of Sequence Data for LIVP Isolates

In this example, the LiVP cionai isolates 1.1.1, 2.1.1, 4.1.1, 5.1.1, 6.1.1, 7.1.1 and 8.1.1 were sequenced and analyzed, and the results were compared to known sequences for Vaccinia virus strains GLV-1h68, Western Reserve and Copenhagen.

LIVP clonal isolates 1.1.1, 2.1.1, 3.1.1, 4.1.1, 5.1.1, 6.1.1, 7.1.1, and 8.1.1 were propagated and titrated in CV-1 cell monolayers. CV-1 cells infected with LIVP clonal isolates 1.1.1, 2.1.1, 3.1.1, 4.1.1, 5.1.1, 6.1.1, 7.1.1 or 8.1.1 were harvested by centrifugation and disrupted by three cycles of freeze and thaw. Cell debris and nucleic were removed from cell lysates by low-speed centrifugation. The recovered viral particles were purified by centrifugation through sucrose cushions and sucrose gradients (20-40%) using standard protocols. Genomic viral DNA was extracted from purified virions after treatment with proteinase K and followed by phenol-chloroform extraction (see, Earl et al., in Ausubel et al., (eds) Current protocols in molecular biology, vol. 3, pages 16.17.1-16.19-7 (1998)).

The genomic DNA was sequenced by shotgun approach and assembled by AGOWA GmbH. Gap closure was performed by additional sequencing runs on the shotgun clones or by PCR using viral genomic DNA. Inverted terminal repeats were reconstructed by comparing the reverse complement sequence to the sequence, identifying identical sequences and extending the flanking sequence. The ORFs were compared to those of known Vaccinia strains GLV-1h68 (SEQ ID NO:9, GenBank Accession No. EU410304), Western Reserve (SEQ ID NO:191, GenBank Accession No. AY243312) and Copenhagen (SEQ ID NO:192, GenBank Accession No. M35027). Tables comparing the major and minor ORFs in these strains can be found in Zhang et al., *Mol Genet Genomics* 282:417-438 (2009). The sequence of each individual LIVP clonal isolate was aligned to the GL-ONC-1 parental LIVP isolate (SEQ ID NO:10) using a Pairwise Sequence Alignment program available from Iowa State University (deepc2.psi.iastate.edu/aat/align/align.html; Huang, X. (1994) *Computer Applications in the Biosciences* 10:227-235). The alignment was computed as a "Global Alignment with GAP." The GAP program computes an optimal global alignment of two sequences without penalizing terminal gaps. A long gap in the shorter sequence is given a constant penalty. The two sequences must be of the same type, that is, both are DNA sequences or both are protein sequences. GAP delivers the alignment in linear space, so long sequences can be aligned. The default parameters were set at "Max Match" score 10, "Min Mismatch," score -15, "Gap-Open penalty" score 30, and "Gap-Extension penalty" Score 3.

Table 63 below sets forth the clonal isolates, including the SEQ ID NO, genome size, nucleotides corresponding to the inverted terminal repeats and percent (%) identity to the GL-ONC-1 parental LIVP isolate (SEQ ID NO:10). Sequencing revealed LIVP 1 isolate 3.1.1 was a mixture of at least 2 sequences.

Table 64 below, sets forth the predicted ORFs, including the name/function, length in nucleotides for the isolates and for GLV-1h68, and the corresponding ORF as identified in GLV-1h68, WR and/or Copenhagen (COP), where applicable. Fragmented ORFs are indicated with an asterisk (*). Table 65 sets forth ORFs that are presumed to be responsible for differences in oncolytic activity and toxicity.

As shown in Table 64 below, several isolates contained truncations in various ORFs. For example, the secreted chemokine binding protein (corresponding to gl001/290, WR001/218 and C23L/B29R in GLV-1h68, WR and Cop, respectively) is truncated by deletion in LIVP isolate 1.1.1. The hypothetical protein corresponding to gl093, WR071 and I2L in GLV-1h68, WR and Cop, respectively, is truncated in GLV-1h68 and LIVP isolate 2.1.1. The profilin-like protein (corresponding to gl225, WR167 and A42R in GLV-1h68, WR and Cop, respectively) is truncated in LIVP isolate 5.1.1. Ankyrin-like protein (corresponding to gl1257, WR188 and B6R in GLV-1h68, WR and Cop, respectively) is truncated in LIVP isolate 4.1.1.

Variability of the length of various corresponding open reading frames has previously been observed amongst different Vaccinia virus strains. For example, the interleukin-18 (IL-18) binding protein (corresponding to gl015/277 and WR 013 in GLV-1h68 and WR, respectively) is 381 bp in Vaccinia strains WR, Lister, and VACV-3737 (GenBank Acc. No. DQ377945) and is 375 bp in Vaccinia strains DUKE (GenBank Acc. No.DQ439815), LC16 (GenBank Acc. No. AY678277), Acam3 (GenBank Acc. No. AY313848) and Acam 2000 (GenBank Acc. No. AY313847). Amongst the LIVP isolates in Table 64, minor differences in length at the C-terminus result in an IL-18 binding protein ORF is 381 bp in isolates 1.1.1, 2.1.1, 4.1.1 and 8.1.1 and is 375 bp in isolates 5.1.1, 6.1.1 and 7.1.1. The alpha-amanitin sensitive protein (corresponding to gl034, WR029 and N2L in GLV-1h68, WR and Cop, respectively) is 528 bp in strains WR, GLV-1h68 and LIVP isolate 5.1.1, but only 513 bp (corresponding to a 5 amino acid deletion) in LIVP isolates 1.1.1, 2.1.1, 4.1.1, 6.1.1, 7.1.1, 8.1.1 and strain Acam3000 (GenBank Acc. No. AY603355). The ankyrin-like protein (corresponding to gl035, WR030 and M1 L in GLV-1h68, WR and Cop, respectively) has been determined to be 1419 bp, 1413 bp or 1410 bp in various Vaccinia virus strains. As shown in Table 64 below, in LIVP isolate 5.1.1, this ORF is 1419 bp whereas the remaining LIVP isolates this ORF contains 1413 base pairs. The Toll/IL1-receptor (corresponding to gl230, WR172 and A46R in GLV-1h68, WR and Cop, respectively) is 723 bp in Vaccinia strain WR and LIVP isolates 1.1.1, 5.1.1 and 7.1.1, 711 bp in LIVP isolates 2.1.1, 4.1.1, 6.1.1 and 8.1.1, and only 645 bp in Vaccinia strain Cop. Similar variability is observed for the ORFS abundant component of virosome (corresponding to gl077, WR061 and E5R in GLV-1h68,

TABLE 63

LIVP clonal isolates

| LIVP isolate | SEQ ID NO | Genome size | Left ITR | Right ITR | % Identity to SEQ ID NO: 10 |
|---|---|---|---|---|---|
| GL-ONC-1 parental LIVP isolate | 10 | 190,217 | 1 . . . 10,072 | 180,096 . . . 190,167 | 100 |
| 1.1.1 | 1 | 183,369 | 1 . . . 2255 | 181,115 . . . 183,369 | 93 |
| 2.1.1 | 2 | 193,964 | 1 . . . 11,242 | 182,722 . . . 193,964 | 97 |
| 4.1.1 | 4 | 187,653 | 1 . . . 6,263 | 181,391 . . . 187,653 | 93 |
| 5.1.1 | 5 | 188,863 | 1 . . . 7,043 | 181,821 . . . 188,863 | 94 |
| 6.1.1 | 6 | 188,082 | 1 . . . 6,673 | 181,410 . . . 188,082 | 94 |
| 7.1.1 | 7 | 188,082 | 1 . . . 6,715 | 181,368 . . . 188,082 | 94 |
| 8.1.1 | 8 | 188,768 | 1 . . . 6,898 | 181,871 . . . 188,768 | 94 |

WR and Cop, respectively) and DNA polymerase (corresponding to gl084, WR065 and E9L in GLV-1h68, WR and Cop, respectively).

LIVP isolates 6.1.1 and 8.1.1 were determined to have DT repeat expansion in unknown protein (corresponding to gl264, WR193 and B11R in GLV-1h68, WR and Cop, respectively) and are 255 base pairs as opposed to 219 by in the remaining isolates and GLV-1h68. The ankyrin-like protein (corresponding to gl273, WR199 and B18R in GLV-1h68, WR and Cop, respectively) is 1725 by in Vaccinia strains WR, Cop, DUKE, Acam3, Acam2000 and Acam3000 but is truncated by a large deletion in LIVP isolates 1.1.1, 4.1.1, 5.1.1, 6.1.1, 7.1.1 and 8.1.1. The IL-1-beta inhibitor (corresponding to gl270, WR197 and B16R in GLV-1h68, WR and Cop, respectively) is generally 981 by but is fragmented in Vaccinia strain Cop (873 bp) and contains deletions in LIVP isolates 1.1.1, 2.1.1, 5.1.1 and 7.1.1.

In addition to the variations in the ORFs, sequencing revealed differences, including insertions and deletions, in the promoter regions of several ORFs. For example, LIVP isolate 1.1.1 has a 6 nucleotide insertion in the promoter region of the serine protease inhibitor-like SPI-10RF (gl009/283). LIVP isolate 8.1.1 has a deletion in the promoter region of the secreted epidermal growth factor-like protein (gl010/282). LIVP isolate 5.1.1 has an 8 nucleotide deletion in the promoter region of the ankyrin-like protein ORF (gl037). LIVP isolate 6.1.1 has a deletion in the promoter region of the ORF encoding an unknown protein (corresponding to gl079). LIVP isolates 1.1.1, 4.1.1, 6.1.1 and 7.1.1 contain 19 nucleotide deletions in the promoter region of the ORF encoding an unknown protein (corresponding to gl088). LIVP isolate 4.1.1 has 2 deletions and isolate 5.1.1 has one deletion in the promoter region of the ORF for the profilin-like protein (gl225).

TABLE 64

LIVP clonal isolates predicted ORFs

| ORF Product | ORF Basepairs | | | | | | | |
|---|---|---|---|---|---|---|---|---|
| | GLV-1h68 | 1.1.1 | 2.1.1 | 4.1.1 | 5.1.1 | 6.1.1 | 7.1.1 | 8.1.1 |
| HSPV001/207 | 147 | 147 | 147 | 147 | 147 | 147 | 147 | 147 |
| putative C ORF G/putative B ORF H | 114 | 114 | 114 | 114 | 114 | 114 | — | 114 |
| secreted chemokine binding protein | 777 | 432 | 777 | 777 | 777 | 777 | 777 | 777 |
| unknown (67 aa) | 204 | — | 204 | 204 | 204 | 204 | 204 | 204 |
| tumor necrosis factor receptor | 192 | 192 | 192 | 192 | 192 | 192 | 192 | 192 |
| TNF-alpha-receptor-like protein | 369 | 369 | 369 | 369 | 369 | 369 | 369 | 369 |
| ankyrin-like protein | 147 | 147 | 147 | 147 | 147 | 147 | 147 | 147 |
| List003*A, List199*D | — | 195 | 195 | 195 | 195 | 195 | 195 | 195 |
| m8RTR06R, m8LTR06L, mOLTR06L, mORTR06R | — | 330 | 330 | 330 | 330 | 330 | 330 | 387 |
| HSPV004/204 | — | 234 | 234 | 234 | 234 | 234 | 234 | — |
| hypothetical protein m8LTR04L, m8RTR04R | — | 414 | 414 | 414 | 330 | 330 | 414 | 414 |
| TNF-alpha-receptor-like (ACAM3000_MVA_002) | — | 165 | 165 | 165 | 165 | 138 | 165 | 165 |
| m8LTR05R, m8RTR05L, mOLTR05R, mORTR05L | — | 240 | 240 | 240 | 213 | 213 | 240 | 240 |
| ankyrin-like protein | 159 | 438 | 438 | 282 | 438 | 438 | 438 | 438 |
| putative C18L-like protein | 150 | 150 | 150 | 150 | 150 | 150 | 150 | 150 |
| putative host-range protein | 966 | 318* 687 | 318* 687 | 1056 | 1275 | 1044 | 540* 492 | 1149 |
| putative C17L-like protein | 261 | 261 | 261 | | | 291 | 261 | |
| serine protease inhibitor-like SPI-1 | 1065 | 1065 | 1065 | 1065 | 1065 | 1065 | 1065 | 1065 |
| putative early and late promoter-like protein | 114 | 114 | 114 | 114 | 114 | 114 | 114 | 114 |
| secreted epidermal growth factor-like protein | 417 | 417 | 417 | 417 | 417 | 417 | 417 | 417 |
| IL-1Ra | 996 | 996 | 996 | 996 | 996 | 996 | 996 | 996 |
| unknown | 198 | 198 | 198 | 198 | 198 | 198 | 198 | 198 |
| zinc finger-like protein | 252 | 252 | 252 | 252 | 252 | 252 | 252 | 252 |
| zinc finger-like protein | 189 | 189 | 189 | 189 | 189 | 189 | 189 | 189 |
| interleukin-18-binding protein | 375 | 381 | 381 | 381 | 375 | 375 | 375 | 381 |
| ankyrin-like protein | 273 | 273 | 273 | 273 | 273 | 273 | 273 | 273 |
| ankyrin-like protein | 540 | 540 | 429 | 540 | 540 | 540 | 429 | 540 |
| ankyrin-like protein | 414 | 414 | 408 | 414 | 414 | 414 | 408 | 414 |
| ankyrin-like protein | 474 | 474 | 513 | 474 | 474 | 474 | 234 | 474 |
| TC10L-like protein | 180 | 180 | 180 | 180 | 180 | 180 | 180 | 180 |
| ankyrin-like protein | 1905 | 1905 | 1905 | 1905 | 1905 | 1905 | 1905 | 1905 |
| unknown | 213 | 213 | 213 | 213 | 213 | 213 | 213 | 213 |
| unknown | 534 | 534 | 534 | 534 | 534 | 534 | 534 | 534 |
| unknown | 138 | 249 | 138 | 138 | 249 | 138 | 138 | 138 |
| unknown | 225 | 225 | 225 | 225 | 225 | 225 | 225 | 225 |
| host-range protein | 453 | 453 | 453 | 453 | 453 | 453 | 453 | 453 |
| unknown | 456 | 456 | 456 | 456 | 456 | 456 | 456 | 456 |
| unknown | 615 | 615 | 615 | 615 | 615 | 615 | 615 | 615 |
| unknown | 951 | 951 | 951 | 951 | 951 | 951 | 951 | 951 |
| secreted complement binding | 792 | 792 | 792 | 792 | 792 | 792 | 792 | 792 |
| unknown | 210 | 210 | 210 | 210 | 210 | 210 | 210 | 210 |
| kelch-like protein | 1539 | 1539 | 1539 | 1539 | 1539 | 1539 | 1539 | 1539 |
| unknown | 675 | 675 | 675 | 675 | 675 | 675 | 675 | 675 |
| virokine | 354 | 354 | 354 | 354 | 354 | 354 | 354 | 354 |
| alpha-amanitin sensitive protein | 528 | 513 | 513 | 513 | 528 | 513 | 513 | 513 |

TABLE 64-continued

| LIVP clonal isolates predicted ORFs | | | | | | | | |
|---|---|---|---|---|---|---|---|---|
| ankyrin-like protein | 1410 | 1413 | 1413 | 1413 | 1419 | 1413 | 1413 | 1413 |
| unknown | 663 | 663 | 663 | 663 | 663 | 663 | 663 | 663 |
| ankyrin-like protein | 855 | 855 | 855 | 855 | 855 | 855 | 855 | 855 |
| serine protease inhibitor-like protein | 1110 | 1110 | 1110 | 1110 | 1110 | 1110 | 1110 | 1110 |
| unknown | 246 | 246 | 246 | 246 | 246 | 246 | 246 | 246 |
| unknown | 303 | 303 | 303 | 303 | 303 | 303 | 303 | 303 |
| hypothetical protein GL041 | 237 | 237 | 237 | 186 | 237 | 237 | 237 | 237 |
| interferon resistance protein | 267 | 267 | 267 | 267 | 267 | 267 | 267 | 267 |
| phospholipase-D-like protein | 1275 | 1275 | 1275 | 1275 | 1275 | 1275 | 1275 | 1275 |
| putative monoglyceride lipase | 135* | | | | | | | |
| putative monoglyceride lipase | 405 | 555 | 555 | 555 | 555 | 555 | 555 | 555 |
| putative monoglyceride lipase | 255 | 255 | 255 | 255 | 255 | 255 | 246 | 255 |
| unknown | 450 | 450 | 450 | 450 | 450 | 450 | 450 | 450 |
| hypothetical protein GL048 | 195 | 195 | 195 | 195 | 195 | 195 | 195 | 195 |
| protein localizes exclusively to the mitochondria where it functions to inhibit apoptosis | 681 | 681 | 681 | 681 | 681 | 681 | 681 | 681 |
| dUTPase | 444 | 444 | 444 | 444 | 444 | 444 | 444 | 444 |
| kelch-like protein | 1443 | 1443 | 1443 | 1443 | 1443 | 1443 | 1443 | 1443 |
| unknown | 204 | 204 | 204 | 204 | 204 | 204 | none | 204 |
| ribonucleotide reductase small subunit | 960 | 960 | 960 | 960 | 960 | 960 | 960 | 960 |
| unknown | 237 | 237 | 237 | 237 | 237 | 237 | 237 | 237 |
| unknown | 291 | 291 | 291 | 291 | 291 | 291 | 291 | 291 |
| major membrane protein | 966 | 966 | 966 | 966 | 966 | 966 | 966 | 966 |
| unknown | 225 | 225 | 225 | 225 | 225 | 225 | 225 | 225 |
| unknown | 243 | 243 | 243 | 243 | 243 | 243 | 243 | 243 |
| protein with iActA-like proline repeats | 198 | 198 | 198 | 198 | 198 | 198 | 198 | 198 |
| S—S bond formation pathway protein | 639 | 639 | 639 | 639 | 639 | 639 | 639 | 639 |
| ser/thr kinase | 1320 | 1320 | 1320 | 1320 | 1320 | 1320 | 1320 | 1320 |
| unknown | 258 | 258 | 258 | 258 | 258 | 258 | 258 | 258 |
| unknown | 1065 | 1065 | 1065 | 1065 | 1065 | 1065 | 1065 | 1065 |
| unknown | 1908 | 1908 | 1908 | 1908 | 1908 | 1908 | 1908 | 1908 |
| unknown | 216 | 216 | 216 | 216 | 216 | 216 | 216 | 216 |
| palmytilated EEV membrane protein | 1119 | 1119 | 1119 | 1119 | 1119 | 1119 | 1119 | 1119 |
| unknown | 222 | 222 | 222 | 222 | 222 | 222 | 222 | 222 |
| 5.5k hypothetical protein F14.5L | insertion | 150 | 150 | 150 | 150 | 150 | 150 | 159 |
| unknown | 477 | 477 | 477 | 477 | 477 | 477 | 477 | 477 |
| unknown | 696 | 696 | 696 | 696 | 696 | 696 | 696 | 696 |
| putative DNA-binding phosphoprotein | 306 | 306 | 306 | 306 | 306 | 306 | 306 | 306 |
| unknown | 213 | 213 | 213 | 213 | 213 | 213 | 213 | 213 |
| poly-A polymerase catalytic subunit VP55 | 1440 | 1440 | 1440 | 1440 | 1440 | 1440 | 1440 | 1440 |
| unknown | 2214 | 2214 | 2214 | 2214 | 2214 | 2214 | 2214 | 2214 |
| double-stranded RNA binding protein | 573 | 573 | 573 | 573 | 573 | 573 | 573 | 573 |
| DNA-dependent RNA polymerase subunit rpo30 | 780 | 780 | 780 | 780 | 780 | 780 | 780 | 780 |
| abundant component of virosome | 1026 | 996 | 996 | 996 | 1026 | 996 | 1026 | 996 |
| unknown | 321 | 321 | 321 | 321 | 321 | 321 | 321 | 321 |
| unknown | 1704 | 1704 | 1704 | 1704 | 1704 | 1704 | 1704 | 1704 |
| soluble myristylprotein | 501 | 501 | 501 | 501 | 501 | 501 | 501 | 501 |
| unknown | 213 | 213 | 213 | 213 | 213 | 213 | 213 | 213 |
| membrane protein | 822 | 822 | 822 | 822 | 822 | 822 | 822 | 822 |
| unknown | 201 | 201 | 201 | 201 | 201 | 201 | 201 | 201 |
| DNA polymerase | 3021 | 3018 | 3018 | 3018 | 3018 | 3018 | 3018 | 3021 |
| unknown | 198 | 198 | 198 | 198 | 198 | 198 | 198 | 198 |
| sulfhydryl oxidase | 288 | 288 | 288 | 288 | 288 | 288 | 288 | 288 |
| virion core protein | 390 | 390 | 390 | 390 | 390 | 390 | 390 | 390 |
| unknown | 2001 | 2001 | 2001 | 2001 | 2001 | 2001 | 2001 | 2001 |
| unknown | 348 | 348 | 348 | 348 | 348 | 348 | 348 | 348 |
| unknown, orthologous to CPXV078A | 189 | — | 189 | — | 189 | — | — | 189 |
| nonessential glutaredoxin | 327 | 324 | 327 | 324 | 327 | 324 | 324 | 327 |
| putative early and late promoter | 108 | 108 | 108 | 108 | 108 | 108 | 108 | 108 |
| DNA-binding core protein | 939 | 939 | 939 | 939 | 939 | 939 | 939 | 939 |
| hypothetical protein GL093 | 216 | 222 | 171 | 222 | 222 | 222 | 222 | 222 |
| ssDNA-binding phosphoprotein | 810 | 810 | 810 | 810 | 810 | 810 | 810 | 810 |
| ribonucleotide reductase large subunit | 2316 | 2316 | 2316 | 2316 | 2316 | 2316 | 2316 | 2316 |
| unknown | 234 | 234 | 234 | 234 | 234 | 234 | 234 | 234 |
| putative CMP70.56R-like protein | 165 | 165 | 165 | 165 | 165 | 165 | 165 | 165 |
| IMV protein VP13 | 240 | 240 | 240 | 240 | 240 | 240 | 240 | 240 |
| unknown | 1149 | 1149 | 1149 | 1149 | 1149 | 1149 | 1149 | 1149 |
| viral core cysteine proteinase | 1272 | 1272 | 1272 | 1272 | 1272 | 1272 | 1272 | 1272 |
| RNA-helicase DExH-NPH-II | 2031 | 2031 | 2031 | 2031 | 2031 | 2031 | 2031 | 2031 |
| insulin metalloproteinase-like protein | 1776 | 1776 | 1776 | 1776 | 1776 | 1776 | 1776 | 1776 |
| unknown | 336 | 336 | 336 | 336 | 336 | 336 | 336 | 336 |
| late transcription elongation factor | 663 | 663 | 663 | 663 | 663 | 663 | 663 | 663 |
| thioredoxin-like protein | 375 | 375 | 375 | 375 | 375 | 375 | 375 | 375 |
| unknown | 1305 | 1305 | 1305 | 1305 | 1305 | 1305 | 1305 | 1305 |
| DNA-dependent RNA polymerase subunit rpo7 | 192 | 192 | 192 | 192 | 192 | 192 | 192 | 192 |

TABLE 64-continued

| LIVP clonal isolates predicted ORFs | | | | | | | | |
|---|---|---|---|---|---|---|---|---|
| unknown | 498 | 498 | 498 | 498 | 498 | 498 | 498 |
| virion structural protein | 1116 | 1116 | 1116 | 1116 | 1116 | 1116 | 1116 |
| unknown | 399 | 399 | 399 | 399 | 399 | 399 | 399 |
| unknown | 210 | 210 | 210 | 210 | 210 | 219 | 210 |
| late gene transcription VLTF-1 | 783 | 783 | 783 | 783 | 783 | 783 | 783 |
| myristylprotein | 1023 | 1023 | 1023 | 1023 | 1023 | 1023 | 1023 |
| IMV membrane protein | 753 | 753 | 753 | 753 | 753 | 753 | 753 |
| unknown | 258 | 258 | 258 | 258 | 258 | 264 | 258 |
| unknown | 1053 | 1053 | 1053 | 1053 | 1053 | 1053 | 1053 |
| core protein vp8 | 756 | 756 | 756 | 756 | 756 | 756 | 756 |
| putative membrane protein | 387 | 387 | 387 | 387 | 387 | 387 | 387 |
| virion protein | 462 | 462 | 462 | 462 | 462 | 462 | 462 |
| thymidine kinase | insertion | 276* | 276* | 534 | 276* | 534 | 276* |
|  |  | 246 | 246 |  | 246 | 246 |  | 246 |
| multifunctional poly-A polymerase subunit | 1002 | 1002 | 1002 | 1002 | 1002 | 1002 | 1002 |
| DNA-dependent RNA polymerase subunit rpo22 | 558 | 558 | 558 | 558 | 558 | 558 | 558 |
| late 16 kDa putative membrane protein | 402 | 402 | 402 | 402 | 402 | 402 | 402 |
| DNA-dependent RNA polymerase subunit rpo147 | 3861 | 3861 | 3861 | 3861 | 3861 | 3861 | 3861 |
| unknown | 216 | 216 | 216 | 216 | 216 | 216 | 216 |
| tyr/ser protein phosphatase | 516 | 516 | 516 | 516 | 516 | 516 | 516 |
| unknown | 570 | 570 | 570 | 570 | 570 | 570 | 570 |
| IMV heparin binding surface protein | 975 | 975 | 975 | 975 | 975 | 975 | 975 |
| RAP94 transcription factor | 2388 | 2388 | 2388 | 2388 | 2388 | 2388 | 2388 |
| late gene transcription factor VLTF-4 | 612 | 612 | 612 | 612 | 612 | 612 | 612 |
| topoisomerase type IB | 945 | 945 | 945 | 945 | 945 | 945 | 945 |
| CPXV116-like protein | 183 | 183 | 183 | 183 | 183 | 183 | 183 |
| unknown | 441 | 441 | 441 | 441 | 441 | 441 | 441 |
| large subunit of mRNA capping enzyme | 2535 | 2535 | 2535 | 2535 | 2535 | 2535 | 2535 |
| hypothetical protein GL136 | 255 | 255 | 255 | 255 | 255 | 255 | 255 |
| virion core protein | 441 | 441 | 441 | 441 | 441 | 441 | 441 |
| unknown | 243 | 243 | 243 | 243 | 243 | 243 | 243 |
| virion core protein | 714 | 714 | 714 | 714 | 714 | 714 | 714 |
| uracil-DNA glycosylase | 657 | 657 | 657 | 657 | 657 | 657 | 657 |
| unknown | 210 | 210 | 210 | 210 | 210 | 210 | 210 |
| NTPase interacts with A20R | 2358 | 2358 | 2358 | 2358 | 2358 | 2358 | 2358 |
| unknown | 219 | 219 | 219 | 219 | 219 | 219 | 219 |
| unknown | 243 | 243 | 243 | 243 | 243 | 243 | 243 |
| transcription factor VETF 70 kDa small subunit | 1914 | 1914 | 1914 | 1914 | 1914 | 1914 | 1914 |
| hypothetical protein GL146 | 192 | 192 | 192 | 192 | 192 | 192 | 192 |
| DNA-dependent RNA polymerase subunit rpo18 | 486 | 486 | 486 | 486 | 486 | 486 | 486 |
| IMV membrane protein | 915 | 915 | 915 | 915 | 915 | 915 | 915 |
| NTP-phosphohydrolase-like protein | 642 | 642 | 642 | 642 | 642 | 642 | 642 |
| NTP-phosphohydrolase-like protein | 747 | 747 | 747 | 747 | 747 | 747 | 747 |
| nucleoside triphosphate phosphohydrolase-I | 1896 | 1896 | 1896 | 1896 | 1896 | 1896 | 1896 |
| unknown | 210 | 210 | 210 | 210 | 210 | 210 | 210 |
| unknown | 159 | 159 | 159 | 159 | 159 | 159 | 159 |
| hypothetical 7.2 KDa protein | 186 | 186 | 186 | 186 | 186 | 186 | 186 |
| small subunit of mRNA capping enzyme | 864 | 864 | 864 | 864 | 864 | 864 | 864 |
| hypothetical 7.0 KDa protein | 189 | 189 | 189 | 189 | 189 | 189 | 189 |
| unknown | 219 | 219 | 219 | 219 | 219 | 219 | 219 |
| rifampicin resistance protein | 1656 | 1656 | 1656 | 1656 | 1656 | 1656 | 1656 |
| unknown | 225 | 225 | — | 225 | 225 | 225 | 225 |
| late gene transcription factor VLTF-2 | 453 | 453 | 453 | 453 | 453 | 453 | 453 |
| late gene transcription factor VLTF-3 | 675 | 675 | 675 | 675 | 675 | 675 | 675 |
| S—S bond formation pathway protein | 231 | 231 | 231 | 231 | 231 | 231 | 231 |
| p4b precursor of core protein 4b | 1935 | 1935 | 1935 | 1935 | 1935 | 1935 | 1935 |
| unknown | 360 | 360 | 360 | 360 | 360 | 360 | 360 |
| 39 kDa core protein | 846 | 846 | 846 | 846 | 846 | 846 | 846 |
| unknown | 261 | 261 | 261 | 261 | 261 | 261 | 261 |
| DNA-dependent RNA polymerase subunit rpo19 | 495 | 495 | 495 | 495 | 495 | 495 | 495 |
| virion core protein required for virus formation | 1119 | 1119 | 1119 | 1119 | 1119 | 1119 | 1119 |
| transcription factor VETF 82 kDa large subunit | 2133 | 2133 | 2133 | 2133 | 2133 | 2133 | 2133 |
| unknown | 387 | 387 | 387 | 387 | 387 | 387 | 387 |
| unknown | 306 | 306 | 306 | 306 | 306 | 306 | 306 |
| transcription factor VITF-3 32 kDa small subunit | 867 | 867 | 867 | 867 | 867 | 867 | 867 |
| IMV membrane protein | 327 | 327 | 327 | 327 | 327 | 327 | 327 |
| precursor p4a of core protein 4a | 2676 | 2676 | 2676 | 2676 | 2676 | 2676 | 2676 |
| unknown | 501 | 501 | 501 | 501 | 501 | 501 | 501 |
| unknown | 228 | 228 | 228 | 228 | 228 | 228 | 228 |
| unknown | 228 | 228 | 228 | 228 | 228 | 228 | 228 |

TABLE 64-continued

| LIVP clonal isolates predicted ORFs | | | | | | | | |
|---|---|---|---|---|---|---|---|---|
| unknown | 957 | 957 | 957 | 957 | 957 | 957 | 957 | 957 |
| core protein | 579 | 579 | 579 | 579 | 579 | 579 | 579 | 579 |
| IMV membrane protein | 213 | 213 | 213 | 213 | 213 | 213 | 213 | 213 |
| phosphorylated IMV membrane protein | 273 | 273 | 273 | 273 | 273 | 273 | 273 | 273 |
| nonessential hydrophobic IV and IMV membrane protein | 162 | 162 | 162 | 162 | 162 | 162 | 162 | 162 |
| unknown | 285 | 285 | 285 | 285 | 285 | 285 | 285 | 285 |
| soluble myristyl protein | 1134 | 1134 | 1134 | 1134 | 1134 | 1134 | 1134 | 1134 |
| IMV membrane protein | 612 | 612 | 612 | 612 | 612 | 612 | 612 | 612 |
| DNA helicase | 1482 | 1482 | 1482 | 1482 | 1482 | 1482 | 1482 | 1482 |
| unknown | 234 | 234 | 234 | 234 | 234 | 234 | 234 | 234 |
| unknown | 354 | 354 | 354 | 354 | 354 | 354 | 354 | 354 |
| viral DNA polymerase processivity factor | 1281 | 1281 | 1281 | 1281 | 1281 | 1281 | 1281 | 1281 |
| unknown | 387 | 387 | 387 | 387 | 387 | 387 | 387 | 387 |
| unknown | 222 | 222 | 222 | 222 | 222 | 222 | 222 | 222 |
| late protein essential for concatemer resolution cleaving DNA concatamers to yield unit-length genome, DNA holiday junction (HJ) resolvase | 564 | 564 | 564 | 564 | 564 | 564 | 564 | 564 |
| transcription factor VITF-3 45 kDa large subunit | 1149 | 1149 | 1149 | 1149 | 1149 | 1149 | 1149 | 1149 |
| DNA-dependent RNA polymerase subunit rpo132 | 3495 | 3495 | 3495 | 3495 | 3495 | 3495 | 3495 | 3495 |
| unknown | 222 | 222 | 222 | 222 | 222 | 222 | 222 | 222 |
| Cowpox A-type inclusion protein | 630 | 630 | 630 | 630 | 198* 471 | 630 | 630 | 630 |
| Cowpox A-type inclusion protein | 684 | 684 | 684 | 684 | 684 | 684 | 684 | 684 |
| TAZ8R-like protein | 174 | 174 | 174 | 174 | 174 | 174 | 174 | 174 |
| TA28R, m8186R, mO186R | 186 | 186 | 186 | 186 | 186 | 186 | 186 | 186 |
| Cowpox A-type inclusion protein | 2166 | 2178 | 2166 | 2178 | 2178 | 2178 | 2166 | 2178 |
| hypothetical protein GL200 | 183 | 183 | 183 | 183 | 183 | 183 | 183 | 183 |
| Cowpox A-type inclusion protein | 1503 | 1503 | 1503 | 1503 | 1503 | 1503 | 1503 | 1509 |
| hypothetical protein GL202 | 495 | 495 | 495 | 495 | 495 | 495 | 495 | 501 |
| IMV surface protein | 333 | 333 | 333 | 333 | 333 | 333 | 333 | 333 |
| membrane component of IMV | 441 | 441 | 441 | 441 | 441 | 441 | 441 | 441 |
| DNA-dependent RNA polymerase rpo35 | 918 | 918 | 918 | 918 | 918 | 918 | 918 | 918 |
| unknown | 213 | 213 | 213 | 213 | 213 | 213 | 213 | 213 |
| IMV protein | 234 | 234 | 234 | 234 | 234 | 234 | 234 | 234 |
| late promoter element in transfected cell | 129 | 129 | 129 | 129 | 129 | 129 | 129 | 129 |
| unknown | 375 | 375 | 375 | 375 | 375 | 375 | 375 | 375 |
| putative ATPase | 813 | 813 | 813 | 813 | 813 | 813 | 813 | 813 |
| unknown | 267 | 267 | 267 | 267 | 267 | 267 | 267 | 267 |
| EEV membrane phosphoglycoprotein | 558 | 558 | 558 | 558 | 558 | 558 | 558 | 558 |
| EEV glycoprotein | 507 | 507 | 507 | 507 | 507 | 507 | 507 | 507 |
| unknown | 231 | 231 | 231 | 231 | 231 | 231 | 231 | 231 |
| intracellular protein of virulence | 531 | 531 | 531 | 531 | 531 | 531 | 531 | 531 |
| IEV transmembrane phosphoprotein | 666 | 666 | 666 | 666 | 666 | 666 | 666 | 666 |
| unknown | 792 | 792 | 792 | 792 | 792 | 792 | 792 | 792 |
| unknown | 252 | 252 | 252 | 252 | 252 | 252 | 252 | 252 |
| unknown | 189 | 189 | 189 | 189 | 189 | 189 | 189 | 189 |
| unknown | 177 | 177 | 177 | 177 | 177 | 177 | 177 | 177 |
| CD47-like antigen/integrin-associated protein | 834 | 834 | 834 | 834 | 834 | 834 | 834 | 834 |
| putative A39R-like protein | 1212 | 1212 | 1212 | 1212 | 1212 | 1212 | 1212 | 1212 |
| unknown | 270 | 270 | 270 | 270 | 270 | 270 | 270 | 270 |
| C-type lectin-like type-II membrane protein | 480 | 480 | 480 | 480 | 480 | 480 | 480 | 480 |
| secreted glycoprotein | 660 | 660 | 660 | 660 | 660 | 660 | 660 | 660 |
| profilin-like protein | 402 | 402 | 402 | 402 | 180 | 402 | 402 | 402 |
| putative type-I membrane glycoprotein | 585 | 585 | 585 | 585 | 582 | 585 | 585 | 585 |
| hypothetical protein GL227 | 237 | 237 | 237 | 237 | 237 | 237 | 237 | 237 |
| hydroxysteroid dehydrogenase | 1041 | 1041 | 1041 | 1041 | 1041 | 1041 | 1041 | 1041 |
| Cu—Zn superoxide dismutase-like protein | 378 | 378 | 378 | 378 | 378 | 378 | 378 | 378 |
| Toll/IL1-receptor | 711 | 723 | 711 | 711 | 723 | 711 | 723 | 711 |
| hypothetical protein GL231 | 318 | 318 | 318 | 318 | 318 | 318 | 318 | 318 |
| unknown | 759 | 759 | 759 | 759 | 759 | 759 | 759 | 759 |
| unknown | 189 | 189 | 189 | 189 | 180 | 189 | 189 | 189 |
| thymidylate kinase | 615 | 684 | 615 | 615 | 615 | 684 | 684 | 684 |
| unknown | 489 | 489 | 489 | 489 | 489 | 489 | 489 | 489 |
| DNA ligase | 1659 | 1659 | 1659 | 1659 | 1659 | 1659 | 1659 | 1659 |
| unknown | 201 | 201 | 201 | 201 | 201 | 201 | 201 | 201 |
| unknown | 204 | 204 | 204 | 204 | 204 | 204 | 204 | 204 |
| unknown | 1005 | 1005 | 261* 651 | 1005 | 1005 | 1005 | 1005 | 1005 |
| Toll/IL1-receptor | 573 | 573 | 573 | 573 | 573 | 573 | 573 | 573 |
| tumor necrosis factor receptor | 561 | 561 | 561 | 561 | 561 | 561 | 561 | 561 |
| tumor necrosis factor receptor (LC16mO) | — | — | — | — | 297 | — | — | — |
| putative CMP170.5L-like protein | 195 | 195 | 195 | 195 | 219 | 195 | 195 | 195 |
| putative CPXV192-like protein | 180 | 180 | 180 | 180 | 180 | 180 | 180 | 180 |
| kelch-like protein | 1695 | 1695 | 1695 | 1695 | 1695 | 1695 | 1695 | 1695 |

TABLE 64-continued

| LIVP clonal isolates predicted ORFs | | | | | | | | |
|---|---|---|---|---|---|---|---|---|
| hemagglutinin | insertion | 930 | 933 | 930 | 942 | 930 | 930 | 930 |
| unknown | 114 | 114 | 114 | 114 | 114 | 114 | 114 | 114 |
| guanylate kinase | 456 | 456 | 456 | 456 | 456 | 456 | 456 | 456 |
| ser/thr kinase | 903 | 903 | 903 | 903 | 903 | 903 | 903 | 903 |
| unknown | 324 | 324 | 324 | 324 | 324 | 324 | 324 | 324 |
| unknown | 660 | 660 | 660 | 660 | 660 | 660 | 660 | 660 |
| unknown | 201 | 201 | 201 | 201 | 201 | 201 | 201 | 201 |
| unknown | 288 | 288 | 288 | 288 | 288 | 288 | 288 | 288 |
| unknown | 375 | 801 | 375 | 801 | 801 | 801 | 183* 186 | 801 |
| unknown | | 537 | 147 | 135 | 147 | 147 | 147 | 138 | 147 |
| unknown | | 150 | 126 | 126 | 126 | 126 | 126 | 126 | 126 |
| hypothetical protein List180 | | 141 | 141 | 141 | 141 | 141 | 141 | 141 | 141 |
| ankyrin-like protein | | 1677 | 1677 | 1677 | 1677 | 1677 | 1677 | 1677 | 1677 |
| EEV type-I membrane glycoprotein | | 954 | 954 | 954 | 954 | 954 | 954 | 954 | 954 |
| ankyrin-like protein | | 522 | 522 | 522 | 504 | 522 | 522 | 522 | 522 |
| unknown | | 216 | 216 | 216 | 216 | 216 | 216 | 216 | 216 |
| 21 kDa precursor protein | | 549 | 549 | 549 | 549 | 549 | 549 | 549 | 549 |
| soluble interferon-gamma receptor-like protein | | 819 | 819 | 819 | 819 | 819 | 819 | 819 | 819 |
| putative RPXV171-Rabbitpox-like protein | | 174 | 174 | 174 | 174 | 174 | 195* 162 | 174 | 195* 162 |
| 6 kDa intracellular viral protein | | 234 | 234 | 234 | 234 | 234 | 201 | 234 | 201 |
| kelch-like protein | | 501 | 501 | 501 | 501 | 501 | 318 | 501 | 318 |
| unknown | | 219 | 219 | 219 | 219 | 219 | 255 | 219 | 255 |
| ser/thr protein kinase-like protein | | 852 | 852 | 852 | 852 | 852 | 852 | 852 | 852 |
| SPI-2/CrmA | | 351 | 351 | 351 | 351 | 351 | 351 | 351 | 351 |
| SPI-2/CrmA | | 669 | 669 | 669 | 669 | 669 | 669 | 669 | 669 |
| IL-1 binding B15R protein | | 450 | 450 | 450 | 450 | 450 | 450 | 450 | 450 |
| unknown | | 174 | 174 | 174 | 174 | 174 | 276 | 174 | 174 |
| IL-1-beta-inhibitor | | 981 | 972 | 972 | 981 | 972 | 981 | 138* 732 | 981 |
| unknown | | 228 | 228 | 228 | 228 | 228 | 228 | 228 | 228 |
| unknown | | 1023 | 1023 | 1023 | 1023 | 1023 | 1023 | 1023 | 1023 |
| ankyrin-like protein | | 1725 | 1242 | 1725 | 1242 | 1239 | 1242 | 1242 | 1242 |
| CrmE [List195, Cowpox] | | — | 504 | — | 504 | 504 | 504 | 504 | 504 |
| Hypothetical protein m8260R, mO260R | | — | 222 | — | 222 | — | 222 | — | — |
| Golgi anti-apoptotic protein [List196, m8261R, mO261R] | | — | 714 | — | 714 | 714 | 714 | 714 | 714 |
| hypothetical protein mO262L, m8262L | | — | 228 | — | 228 | 228 | 228 | 228 | 228 |
| hypothetical protein m8001R, mO001R | | — | 171 | — | 144 | 156 | 174 | 174 | 174 |
| hypothetical protein m8LTR01L, m8RTR01R | | — | 198 | — | 450 | 444 | 444 | 444 | 444 |
| IFN-alpha/beta-receptor-like secreted glycoprotein | | 1056 | — | 1056 | — | — | — | — | — |
| putative B20R-like protein | | 420 | — | 420 | — | — | — | — | — |
| unknown | | 162 | — | 162 | — | — | — | — | — |
| interleukin-18-binding protein | | 375 | — | 516 | — | — | — | — | — |
| zinc finger-like protein | | 189 | — | — | — | — | — | — | — |
| zinc finger-like protein | | 252 | — | 252 | — | — | — | — | — |
| IL-1Ra | | 996 | — | 996 | — | — | — | — | — |
| unknown | | 198 | — | 198 | — | — | — | — | — |
| secreted epidermal growth factor-like protein | | 417 | — | 417 | — | — | — | — | — |
| putative early and late promoter | | 114 | — | 114 | — | — | — | — | — |
| serine protease inhibitor-like SPI-1 | | 1065 | — | 1065 | — | — | — | — | — |
| putative C17L-like protein | | 261 | — | 261 | 279 | — | 291 | 261 | — |
| putative host-range protein | | 966 | — | 687* 318 | 1056 | 1275 | 1044 | 492* 540 | 1179 |
| putative C18L-like protein | | 150 | — | 150 | 150 | 150 | 150 | 150 | 150 |
| ankyrin-like protein | | 159 | — | 438 | 282 | 438 | 438 | 438 | 438 |
| m8LTR05R, m8RTR05L, mOLTR05R, mORTR05L | | — | — | 240 | 240 | 213 | 213 | 240 | 240 |
| hypothetical protein m8LTR04L, m8RTR04R | | — | — | 414 | 414 | 330 | 330 | 414 | 414 |
| TNF-alpha-receptor-like (ACAM3000_MVA_192) | | — | — | 165 | 165 | 165 | 138 | 165 | 165 |
| HSPV004/204 | | — | — | 234 | 234 | 234 | 234 | 234 | — |
| hypothetical protein m8LTR06L m8RTR06R | | — | — | 330 | 330 | 330 | 330 | 330 | 387 |
| List003*A, List199*D | | — | — | 195 | 195 | 195 | 195 | 195 | 195 |
| ankyrin-like protein | | 147 | — | 147 | 147 | 147 | 147 | 147 | 147 |
| TNF-alpha-receptor-like protein | | 369 | — | 369 | 369 | 369 | 369 | 369 | 369 |
| tumor necrosis factor receptor | | 192 | 192 | 192 | 192 | 192 | 192 | 192 | 192 |
| secreted chemokine binding protein | | 777 | 432 | 777 | 777 | 777 | 777 | 777 | 777 |
| unknown | | 204 | — | 204 | 204 | 204 | 204 | 204 | 204 |
| putative C ORF G/ putative B ORF H | | 114 | 114 | 114 | 114 | 114 | 114 | 213 | 114 |

TABLE 64-continued

| LIVP clonal isolates predicted ORFs | | | | | | | | |
|---|---|---|---|---|---|---|---|---|
| HSPV001/207, CPXV002/228 protein | 147 | 147 | 147 | 147 | 147 | 147 | 147 | 147 |

| | | ORF* | | |
|---|---|---|---|---|
| | ORF Product | GLV-1h68 | WR | Cop |
| | HSPV001/207 putative C ORF G/putative B ORF H | | | |
| | secreted chemokine binding protein | gl001/290 | WR001/218 | C23L/B29R |
| | unknown (67 aa) | gl002/291 | | |
| | tumor necrosis factor receptor | gl003/289 | | |
| | TNF-alpha-receptor-like protein | gl004/288 | WR004/215 | C22L/B28R |
| | ankyrin-like protein | gl004.5/287.5 | WR005/214 | |
| | List003*A, List199*D | None | WR006/213 | C21L/B27R |
| | m8RTR06R, m8LTR06L, mOLTR06L, mORTR06R | None | WR007/212 | |
| | HSPV004/204 | None | | |
| | hypothetical protein m8LTR04L, m8RTR04R | None | WR008/211 | C19L/B25R |
| | TNF-alpha-receptor-like (ACAM3000_MVA_002) | None | | |
| | m8LTR05R, m8RTR05L, mOLTR05R, mORTR05L | None | | |
| | ankyrin-like protein | gl005/287 | | |
| | putative C18L-like protein | gl006/286 | | C18L/B24R |
| | putative host-range protein | gl007/285 | | C17L/B23R |
| | putative C17L-like protein | gl008/284 | | C17L/B23R |
| | serine protease inhibitor-like SPI-1 | gl009/283 | WR205 | C12L |
| | putative early and late promoter-like protein | gl009.5/282.5 | WR204.5 | 264 |
| | secreted epidermal growth factor-like protein | gl010/282 | WR009/210 | C11R |
| | IL-1Ra | gl011/280 | WR010/209 | C10L |
| | unknown | gl012/281 | | |
| | zinc finger-like protein | gl013/279 | WR011/208 | |
| | zinc finger-like protein | gl014/278 | WR012/207 | |
| | interleukin-18-binding protein | gl015 | WR013 | |
| | ankyrin-like protein | gl016 | WR014 | |
| | ankyrin-like protein | gl017 | WR014 | |
| | ankyrin-like protein | gl018 | WR015 | |
| | ankyrin-like protein | gl019 | WR016, WR017 | |
| | TC10L-like protein | gl020 | | |
| | ankyrin-like protein | gl021 | WR019 | C9L |
| | unknown | gl022 | | |
| | unknown | gl023 | WR020 | C8L |
| | unknown | gl023.5 | | |
| | unknown | gl024 | | |
| | host-range protein | gl025 | WR021 | C7L |
| | unknown | gl026 | WR022 | C6L |
| | unknown | gl027 | WR023 | C5L |
| | unknown | gl028 | WR024 | C4L |
| | secreted complement binding | gl029 | WR025 | C3L |
| | unknown | gl030 | | |
| | kelch-like protein | gl031 | WR026 | C2L |
| | unknown | gl032 | WR027 | C1L |
| | virokine | gl033 | WR028 | N1L |
| | alpha-amanitin sensitive protein | gl034 | WR029 | N2L |
| | ankyrin-like protein | gl035 | WR030 | M1L |
| | unknown | gl036 | WR031 | M2L |
| | ankyrin-like protein | gl037 | WR032 | K1L |
| | serine protease inhibitor-like protein | gl038 | WR033 | K2L |
| | unknown | gl039 | | |
| | unknown | gl040 | | |
| | hypothetical protein GL041 | gl041 | | |
| | interferon resistance protein | gl042 | WR034 | K3L |
| | phospholipase-D-like protein | gl043 | WR035 | K4L |
| | putative monoglyceride lipase | gl044 | WR036 | |
| | putative monoglyceride lipase | gl045 | WR037 | K5L |
| | putative monoglyceride lipase | gl046 | WR038 | K6L |
| | unknown | gl047 | WR039 | K7R |
| | hypothetical protein GL048 | gl048 | | |
| | protein localizes exclusively to the mitochondria where it functions to inhibit apoptosis | gl049 | WR040 | F1L |
| | dUTPase | gl050 | WR041 | F2L |
| | kelch-like protein | gl051 | WR042 | F3L |

TABLE 64-continued

LIVP clonal isolates predicted ORFs

| | | | |
|---|---|---|---|
| unknown | gl052 | | |
| ribonucleotide reductase small subunit | gl053 | WR043 | F4L |
| unknown | gl054 | | |
| unknown | gl055 | | |
| major membrane protein | gl056 | WR044 | F5L |
| unknown | gl057 | WR045 | F6L |
| unknown | gl058 | WR046 | F7L |
| protein with iActA-like proline repeats | gl059 | WR047 | F8L |
| S—S bond formation pathway protein | gl060 | WR048 | F9L |
| ser/thr kinase | gl061 | WR049 | F10L |
| unknown | gl062 | | |
| unknown | gl063 | WR050 | F11L |
| unknown | gl064 | WR051 | F12L |
| unknown | gl065 | | |
| palmytilated EEV membrane protein | gl066 | WR052 | F13L |
| unknown | gl067 | WR053 | F14L |
| 5.5k hypothetical protein F14.5L | gl068 | WR053.5 | F14.5L |
| unknown | gl069 | WR054 | F15L |
| unknown | gl070 | WR055 | F16L |
| putative DNA-binding phosphoprotein | gl071 | WR056 | F17R |
| unknown | gl072 | | |
| poly-A polymerase catalytic subunit VP55 | gl073 | WR057 | E1L |
| unknown | gl074 | WR058 | E2L |
| double-stranded RNA binding protein | gl075 | WR059 | E3L |
| DNA-dependent RNA polymerase subunit rpo30 | gl076 | WR060 | E4L |
| abundant component of virosome | gl077 | WR061 | E5R |
| unknown | gl078 | | |
| unknown | gl079 | WR062 | E6R |
| soluble myristylprotein | gl080 | WR063 | E7R |
| unknown | gl081 | | |
| membrane protein | gl082 | WR064 | E8R |
| unknown | gl083 | | |
| DNA polymerase | gl084 | WR065 | E9L |
| unknown | gl085 | | |
| sulfhydryl oxidase | gl086 | WR066 | E10R |
| virion core protein | gl087 | WR067 | E11L |
| unknown | gl088 | WR068 | O1L |
| unknown | gl089 | | |
| unknown, orthologous to CPXV078A | gl090 | | |
| nonessential glutaredoxin | gl091 | WR069 | O2L |
| putative early and late promoter | gl091.5 | WR069.5 | 266 |
| DNA-binding core protein | gl092 | WR070 | I1L |
| hypothetical protein GL093 | gl093 | WR071 | I2L |
| ssDNA-binding phosphoprotein | gl094 | WR072 | I3L |
| ribonucleotide reductase large subunit | gl095 | WR073 | I4L |
| unknown | gl096 | | |
| putative CMP70.56R-like protein | gl097 | | |
| IMV protein VP13 | gl098 | WR074 | I5L |
| unknown | gl099 | WR075 | I6L |
| viral core cysteine proteinase | gl100 | WR076 | I7L |
| RNA-helicase DExH-NPH-II | gl101 | WR077 | I8R |
| insulin metalloproteinase-like protein | gl102 | WR078 | G1L |
| unknown | gl103 | WR079 | G3L |
| late transcription elongation factor | gl104 | WR080 | G2R |
| thioredoxin-like protein | gl105 | WR081 | G4L |
| unknown | gl106 | WR082 | G5R |
| DNA-dependent RNA polymerase subunit rpo7 | gl107 | WR083 | G5.5R |
| unknown | gl108 | WR084 | G6R |
| virion structural protein | gl109 | WR085 | G7L |
| unknown | gl110 | | |
| unknown | gl111 | | |
| late gene transcription VLTF-1 | gl112 | WR086 | G8R |
| myristylprotein | gl113 | WR087 | G9R |
| IMV membrane protein | gl114 | WR088 | L1R |
| unknown | gl115 | WR089 | L2R |
| unknown | gl116 | WR090 | L3L |
| core protein vp8 | gl117 | WR091 | L4R |
| putative membrane protein | gl118 | WR092 | L5R |
| virion protein | gl119 | WR093 | J1R |
| thymidine kinase | gl120 | WR094 | J2R |
| | gl121 | | |
| multifunctional poly-A polymerase subunit | gl122 | WR095 | J3R |
| DNA-dependent RNA polymerase subunit rpo22 | gl123 | WR096 | J4R |
| late 16 kDa putative membrane protein | gl124 | WR097 | J5L |

TABLE 64-continued

LIVP clonal isolates predicted ORFs

| | | | |
|---|---|---|---|
| DNA-dependent RNA polymerase subunit rpo147 | gl125 | WR098 | J6R |
| unknown | gl126 | | |
| tyr/ser protein phosphatase | gl127 | WR099 | H1L |
| unknown | gl128 | WR100 | H2R |
| IMV heparin binding surface protein | gl129 | WR101 | H3L |
| RAP94 transcription factor | gl130 | WR102 | H4L |
| late gene transcription factor VLTF-4 | gl131 | WR103 | H5R |
| topoisomerase type IB | gl132 | WR104 | H6R |
| CPXV116-like protein | gl133 | | |
| unknown | gl134 | WR105 | H7R |
| large subunit of mRNA capping enzyme | gl135 | WR106 | D1R |
| hypothetical protein GL136 | gl136 | | |
| virion core protein | gl137 | WR107 | D2L |
| unknown | gl138 | | |
| virion core protein | gl139 | WR108 | D3R |
| uracil-DNA glycosylase | gl140 | WR109 | D4R |
| unknown | gl141 | | |
| NTPase interacts with A20R | gl142 | WR110 | D5R |
| unknown | gl143 | | |
| unknown | gl144 | | |
| transcription factor VETF 70 kDa small subunit | gl145 | WR111 | D6R |
| hypothetical protein GL146 | gl146 | | |
| DNA-dependent RNA polymerase subunit rpo18 | gl147 | WR112 | D7R |
| IMV membrane protein | gl148 | WR113 | D8L |
| NTP-phosphohydrolase-like protein | gl149 | WR114 | D9R |
| NTP-phosphohydrolase-like protein | gl150 | WR115 | D10R |
| nucleoside triphosphate phosphohydrolase-I | gl151 | WR116 | D11L |
| unknown | gl152 | | |
| unknown | gl153 | | |
| hypothetical 7.2 KDa protein | gl154 | | |
| small subunit of mRNA capping enzyme | gl155 | WR117 | D12L |
| hypothetical 7.0 KDa protein | gl156 | | |
| unknown | gl157 | | |
| rifampicin resistance protein | gl158 | WR118 | D13L |
| unknown | gl159 | | |
| late gene transcription factor VLTF-2 | gl160 | WR119 | A1L |
| late gene transcription factor VLTF-3 | gl161 | WR120 | A2L |
| S—S bond formation pathway protein | gl162 | WR121 | A2.5L |
| p4b precursor of core protein 4b | gl163 | WR122 | A3L |
| unknown | gl164 | | |
| 39 kDa core protein | gl165 | WR123 | A4L |
| unknown | gl166 | | |
| DNA-dependent RNA polymerase subunit rpo19 | gl167 | WR124 | A5R |
| virion core protein required for virus formation | gl168 | WR125 | A6L |
| transcription factor VETF 82 kDa large subunit | gl169 | WR126 | A7L |
| unknown | gl170 | | |
| unknown | gl171 | | |
| transcription factor VITF-3 32 kDa small subunit | gl172 | WR127 | A8R |
| IMV membrane protein | gl173 | WR128 | A9L |
| precursor p4a of core protein 4a | gl174 | WR129 | A10L |
| unknown | gl175 | | |
| unknown | gl176 | | |
| unknown | gl177 | | |
| unknown | gl178 | WR130 | A11R |
| core protein | gl179 | WR131 | A12L |
| IMV membrane protein | gl180 | WR132 | A13L |
| phosphorylated IMV membrane protein | gl181 | WR133 | A14L |
| nonessential hydrophobic IV and IMV membrane protein | gl182 | WR134 | A14.5L |
| unknown | gl183 | WR135 | A15L |
| soluble myristyl protein | gl184 | WR136 | A16L |
| IMV membrane protein | gl185 | WR137 | A17L |
| DNA helicase | gl186 | WR138 | A18R |
| unknown | gl187 | WR139 | A19L |
| unknown | gl188 | WR140 | A21L |
| viral DNA polymerase processivity factor | gl189 | WR141 | A20R |
| unknown | gl190 | | |
| unknown | gl191 | | |

TABLE 64-continued

LIVP clonal isolates predicted ORFs

| | | | |
|---|---|---|---|
| late protein essential for concatemer resolution cleaving DNA concatamers to yield unit-length genome, DNA holiday junction (HJ) resolvase | gl192 | WR142 | A22R |
| transcription factor VITF-3 45 kDa large subunit | gl193 | WR143 | A23R |
| DNA-dependent RNA polymerase subunit rpo132 | gl194 | WR144 | A24R |
| unknown | gl195 | | |
| Cowpox A-type inclusion protein | gl196 | WR145 WR146 | A25L |
| Cowpox A-type inclusion protein | gl197 | WR147 | |
| TAZ8R-like protein TA28R, m8186R, mO186R | gl198 | | |
| Cowpox A-type inclusion protein | gl199 | WR148 | |
| hypothetical protein GL200 | gl200 | | |
| Cowpox A-type inclusion protein | gl201 | WR149 | A26L |
| hypothetical protein GL202 | gl202 | | |
| IMV surface protein | gl203 | WR150 | A27L |
| membrane component of IMV | gl204 | WR151 | A28L |
| DNA-dependent RNA polymerase rpo35 | gl205 | WR152 | A29L |
| unknown | gl206 | | |
| IMV protein | gl207 | WR153 | A30L |
| late promoter element in transfected cell | gl207.5 | WR153.5 | A30.5L |
| unknown | gl208 | WR154 | A31R |
| putative ATPase | gl209 | WR155 | A32L |
| unknown | gl210 | | |
| EEV membrane phosphoglycoprotein | gl211 | WR156 | A33R |
| EEV glycoprotein | gl212 | WR157 | A34R |
| unknown | gl213 | | |
| intracellular protein of virulence | gl214 | WR158 | A35R |
| IEV transmembrane phosphoprotein | gl215 | WR159 | A36R |
| unknown | gl216 | WR160 | A37R |
| unknown | gl217 | | |
| unknown | gl218 | WR161 | |
| unknown | gl219 | | |
| CD47-like antigen/integrin-associated protein | gl220 | WR162 | A38L |
| putative A39R-like protein | gl221 | WR163, WR164 | A39R |
| unknown | gl222 | | |
| C-type lectin-like type-II membrane protein | gl223 | WR165 | A40R |
| secreted glycoprotein | gl224 | WR166 | A41L |
| profilin-like protein | gl225 | WR167 | A42R |
| putative type-I membrane glycoprotein | gl226 | WR168 | A43R |
| hypothetical protein GL227 | gl227 | WR169 | 268 |
| hydroxysteroid dehydrogenase | gl228 | WR170 | A44L |
| Cu—Zn superoxide dismutase-like protein | gl229 | WR171 | A45R |
| Toll/IL1-receptor | gl230 | WR172 | A46R |
| hypothetical protein GL231 | gl231 | | |
| unknown | gl232 | WR173 | A47L |
| unknown | gl233 | | |
| thymidylate kinase | gl234 | WR174 | A48R |
| unknown | gl235 | WR175 | A49R |
| DNA ligase | gl236 | WR176 | A50R |
| unknown | gl237 | | |
| unknown | gl238 | | |
| unknown | gl239 | WR177 | A51R |
| Toll/IL1-receptor | gl240 | WR178 | A52R |
| tumor necrosis factor receptor tumor necrosis factor receptor (LC16mO) | gl241 | WR179 | A53R |
| putative CMP170.5L-like protein | gl242 | | |
| putative CPXV192-like protein | gl243 | | |
| kelch-like protein | gl244 | WR180 | A55R |
| hemagglutinin | gl245 | WR181 | A56R |
| unknown | gl245.5 | WR181.5 | 269 |
| guanylate kinase | gl246 | WR182 | A57R |
| ser/thr kinase | gl247 | WR183 | B1R |
| unknown | gl248 | | |
| unknown | gl249 | WR184 | B2R |
| unknown | gl250 | | |
| unknown | gl251 | | |
| unknown | gl252 | WR185 | B3R |
| unknown | gl253 | | |
| unknown | gl254 | | |
| hypothetical protein List180 ankyrin-like protein | gl255 | WR186 | B4R |
| EEV type-I membrane glycoprotein | gl256 | WR187 | B5R |
| ankyrin-like protein | gl257 | WR188 | B6R |

TABLE 64-continued

| LIVP clonal isolates predicted ORFs | | | |
|---|---|---|---|
| unknown | gl258 | | |
| 21 kDa precursor protein | gl259 | WR189 | B7R |
| soluble interferon-gamma receptor-like protein | gl260 | WR190 | B8R |
| putative RPXV171-Rabbitpox-like protein | gl261 | | |
| 6 kDa intracellular viral protein | gl262 | WR191 | B9R |
| kelch-like protein | gl263 | WR192 | B10R |
| unknown | gl264 | WR193 | B11R |
| ser/thr protein kinase-like protein | gl265 | WR194 | B12R |
| SPI-2/CrmA | gl266 | WR195 | B13R |
| SPI-2/CrmA | gl267 | WR195 | B14R |
| IL-1 binding B15R protein | gl268 | WR196 | B15R |
| unknown | gl269 | | |
| IL-1-beta-inhibitor | gl270 | WR197 | 270, B16R |
| unknown | gl271 | | |
| unknown | gl272 | WR198 | B17L |
| ankyrin-like protein | gl273 | WR199 | B18R |
| CrmE [List195, Cowpox] | None | | |
| Hypothetical protein m8260R, mO260R | None | | |
| Golgi anti-apoptotic protein [List196, m8261R, mO261R] | None | | |
| hypothetical protein mO262L, m8262L | None | | |
| hypothetical protein m8001R, mO001R | None | | |
| hypothetical protein m8LTR01L, m8RTR01R | None | | |
| IFN-alpha/beta-receptor-like secreted glycoprotein | gl274 | WR200 | B19R |
| putative B20R-like protein | gl275 | WR202 | B20R |
| unknown | gl276 | | |
| interleukin-18-binding protein | gl277/105 | WR013 | |
| zinc finger-like protein | gl278/014 | WR207/012 | |
| zinc finger-like protein | gl279/013 | WR208/011 | |
| IL-1Ra | gl280/011 | WR209/010 | C10L |
| unknown | gl281/012 | | |
| secreted epidermal growth factor-like protein | gl282/010 | WR210/009 | C11R |
| putative early and late promoter | gl282.5/009.5 | WR204.5 | 264 |
| serine protease inhibitor-like SPI-1 | gl283/009 | WR205 | C12L |
| putative C17L-like protein | gl284/008 | | B23R/C17L |
| putative host-range protein | gl285/007 | | B23R/C17L |
| putative C18L-like protein | gl286/006 | | B24R/C18L |
| ankyrin-like protein | gl287/005 | | |
| m8LTR05R, m8RTR05L, mOLTR05R, mORTR05L | None | | |
| hypothetical protein m8LTR04L, m8RTR04R | None | | B25R/C19L |
| TNF-alpha-receptor-like (ACAM3000_MVA_192) | None | | |
| HSPV004/204 | None | | |
| hypothetical protein m8LTR06L m8RTR06R | None | WR212/007 | |
| List003*A, List199*D | None | WR213/006 | B27R/C21L |
| ankyrin-like protein | gl287.5/004.5 | WR214/005 | |
| TNF-alpha-receptor-like protein | gl288/004 | WR215/004 | B28R/C22L |
| tumor necrosis factor receptor | gl289/003 | | |
| secreted chemokine binding protein | gl290/001 | WR218/001 | B29R/C23L |
| unknown | gl291/002 | | |
| putative C ORF G/ | | | |
| putative B ORF H | | | |
| HSPV001/207, CPXV002/228 protein | | | |

*Fragmented ORF;
— Deletion (no corresponding ORF) or nucleotide change (ORF too small to be reported (e.g., <102 bp))

TABLE 65

Selected ORFs

| | ORF Basepairs | | | | | | | | ORF* | | |
|---|---|---|---|---|---|---|---|---|---|---|---|
| | GLV- | | | | | | | | | | |
| ORF Product | 1h68 | 1.1.1 | 2.1.1 | 4.1.1 | 5.1.1 | 6.1.1 | 7.1.1 | 8.1.1 | GLV-1h68 | WR | Cop |
| secreted chemokine binding protein | 777 | 432 | 777 | 777 | 777 | 777 | 777 | 777 | gl001/290 | WR001/218 | C23L/B29R |
| serine protease inhibitor-like SPI-1 | 1065 | 1065 | 1065 | 1065 | 1065 | 1065 | 1065 | 1065 | gl009/283 | WR205 | C12L |
| secreted epidermal growth factor-like protein | 417 | 417 | 417 | 417 | 417 | 417 | 417 | 417 | gl010/282 | WR009/210 | C11R |
| IL-1Ra | 996 | 996 | 996 | 996 | 996 | 996 | 996 | 996 | gl011/280 | WR010/209 | C10L |
| interleukin-18-binding protein | 375 | 381 | 381 | 381 | 375 | 375 | 375 | 381 | gl015 | WR013 | |
| unknown | 675 | 675 | 675 | 675 | 675 | 675 | 675 | 675 | gl032 | WR027 | C1L |
| alpha-amanitin sensitive protein | 528 | 513 | 513 | 513 | 528 | 513 | 513 | 513 | gl034 | WR029 | N2L |
| ankyrin-like protein | 1410 | 1413 | 1413 | 1413 | 1419 | 1413 | 1413 | 1413 | gl035 | WR030 | M1L |
| ankyrin-like protein | 855 | 855 | 855 | 855 | 855 | 855 | 855 | 855 | gl037 | WR032 | K1L |
| unknown | 477 | 477 | 477 | 477 | 477 | 477 | 477 | 477 | gl069 | WR054 | F15L |
| abundant component of virosome | 1026 | 996 | 996 | 996 | 1026 | 996 | 1026 | 996 | gl077 | WR061 | E5R |
| unknown | 1704 | 1704 | 1704 | 1704 | 1704 | 1704 | 1704 | 1704 | gl079 | WR062 | E6R |
| membrane protein | 822 | 822 | 822 | 822 | 822 | 822 | 822 | 822 | gl082 | WR064 | E8R |
| DNA polymerase | 3021 | 3018 | 3018 | 3018 | 3018 | 3018 | 3018 | 3021 | gl084 | WR065 | E9L |
| unknown | 2001 | 2001 | 2001 | 2001 | 2001 | 2001 | 2001 | 2001 | gl088 | WR068 | O1L |
| hypothetical protein GL093 | 216 | 222 | 171 | 222 | 222 | 222 | 222 | 222 | gl093 | WR071 | I2L |
| profilin-like protein | 402 | 402 | 402 | 402 | 180 | 402 | 402 | 402 | gl225 | WR167 | A42R |
| Toll/IL1-receptor | 711 | 723 | 711 | 711 | 723 | 711 | 723 | 711 | gl230 | WR172 | A46R |
| unknown | 1005 | 1005 | 261*<br>651 | 1005 | 1005 | 1005 | 1005 | 1005 | gl239 | WR177 | A51R |
| tumor necrosis factor receptor | 561 | 561 | 561 | 561 | 561 | 561 | 561 | 561 | gl241 | WR179 | A53R |
| ankyrin-like protein | 522 | 522 | 522 | 504 | 522 | 522 | 522 | 522 | gl257 | WR188 | B6R |
| unknown | 219 | 219 | 219 | 219 | 219 | 255 | 219 | 255 | gl264 | WR193 | B11R |
| IL-1-beta-inhibitor | 981 | 972 | 972 | 981 | 972 | 981 | 138*<br>732 | 981 | gl270 | WR197 | B11R |
| ankyrin-like protein | 1725 | 1242 | 1725 | 1242 | 1239 | 1242 | 1242 | 1242 | gl273 | WR199 | B18R |
| CrmE [List195, Cowpox] | — | 504 | — | 504 | 504 | 504 | 504 | 504 | None | | |
| Golgi anti-apoptotic protein [List196, m8261R, mO261R] | — | 714 | — | 714 | 714 | 714 | 714 | 714 | None | | |
| hypothetical protein m8LTR01L, m8RTR01R | — | 198 | — | 450 | 444 | 444 | 444 | 444 | None | | |
| IFN-alpha/beta-receptor-like secreted glycoprotein | 1056 | — | 1056 | — | — | — | — | — | gl274 | WR200 | B19R |
| interleukin-18-binding protein | 375 | — | 516 | — | — | — | — | — | gl277/105 | WR013 | |
| IL-1Ra | 996 | — | 996 | — | — | — | — | — | gl280/011 | WR209/010 | C10L |
| secreted epidermal growth factor-like protein | 417 | — | 417 | — | — | — | — | — | gl282/010 | WR210/009 | C11R |
| serine protease inhibitor-like SPI-1 | 1065 | — | 1065 | — | — | — | — | — | gl283/009 | WR205 | C12L |

Example 11

Introduction of a Gene Encoding a Heterologous Protein into a LIVP Clonal Isolate In this Example, a gene encoding a heterologous protein is inserted into a LIVP clonal isolate by 1) direct cloning or 2) homologous recombination.

A. Direct Cloning

In this Example, an LIVP virus that encodes a heterologous protein is constructed by direct cloning according to the method set forth in Scheiflinger et al. (1992) *Proc. Natl. Acad. Sci. USA* 89: 9977-9981 and U.S. Pat. No. 6,265,183. In this method, the nucleic acid that encodes the heterologous protein is inserted into a unique restriction endonuclease cleavage site located in a nonessential region in the viral genome. For example, the gene encoding the heterologous protein is inserted into the NotI site of LIVP 1.1.1, LIVP 2.1.1, LIVP 3.1.1, LIVP 4.1.1, LIVP 5.1.1, LIVP 6.1.1, LIVP 7.1.1, LIVP 8.1.1 and GLV-1h68 (GL-ONC1). A list of exemplary encoded heterologous proteins, and the encoding nucleic acid sequence (SEQ ID NO) is set forth in Table 66 below.

TABLE 66

Heterologous genes

| Detectable gene products | SEQ ID NO |
|---|---|
| Optical Imaging | |
| Luciferase | |
| luciferase (from *Vibrio harveyi* or *Vibrio fischerii*) | |
| luxA | 27 |
| luxB | 28 |
| luxC | 29 |
| luxD | 30 |
| luxE | 31 |
| luxAB | 314 |
| luxCD | 317 |
| luxABCDE | 323 |
| click beetle luciferase | |
| CBG99-mRFP1 | 25 |
| Fusion Proteins | |
| Ruc-GFP | 24 |
| Fluorescent Proteins | |
| far-red fluorescent protein | |
| TurboFP635 expression vector | 283 |
| mNeptune monomeric far-red fluorescent protein | 85 |
| IFP (infrared fluorescent protein) | 284 |

TABLE 66-continued

Heterologous genes

| Detectable gene products | SEQ ID NO |
|---|---|
| frp Flavin Reductase | 84 |
| CBP Coelenterazine-binding protein 1 | 86 |
| PET imaging | |
| Cyp11B1 transcript variant 1 | 40 |
| Cyp11B1 transcript variant 2 | 39 |
| Cyp11B2 | 41 |
| AlstR | 87 |
| PEPR-1 | 194 |
| LAT-4 or SLC43A2 | 88 |
| Cyp51 transcript variant 1 | 42 |
| Cyp51 transcript variant 2 | 43 |
| Transporter proteins | |
| Solute carrier transporter protein families (SLC) | |
| SLC5 solute carrier 5 transporter protein family | |
| SLC5A1 sodium/glucose cotransporter 1 | 109 |
| SLC5A2 sodium/glucose cotransporter 2 | 110 |
| SLC5A3 sodium/myo-inositol cotransporter | 111 |
| SLC5A4 low affinity sodium-glucose cotransporter | 112 |
| SLC5A5 sodium/iodide cotransporter | 108 |
| SLC5A6 sodium-dependent multivitamin transporter | 113 |
| SLC5A7 high affinity choline transporter 1 | 114 |
| SLC5A8 sodium-coupled monocarboxylate transporter 1 | 115 |
| SLC5A9 sodium/glucose cotransporter 4 | 116 |
| SLC5A10 sodium/glucose cotransporter 5, isoform 1 | 117 |
| sodium/glucose cotransporter 5, isoform 2 | 118 |
| sodium/glucose cotransporter 5, isoform 3 | 119 |
| sodium/glucose cotransporter 5, isoform 4 | 120 |
| SLC5A11 sodium/myo-inositol cotransporter 2, isoform 1 | 121 |
| sodium/myo-inositol cotransporter 2, isoform 2 | 122 |
| sodium/myo-inositol cotransporter 2, isoform 3 | 123 |
| sodium/myo-inositol cotransporter 2, isoform 4 | 124 |
| SLC5A12 sodium-coupled monocarboxylate transporter 2, isoform 1 | 125 |
| sodium-coupled monocarboxylate transporter 2, isoform 2 | 126 |
| Sodium Iodide Symporter (NIS) | |
| hNIS (NM_000453) | 36 |
| hNIS (BC105049) | 37 |
| hNIS (BC105047) | 38 |
| hNIS (non-functional hNIS variant containing an additional 11 aa) | 289 |
| SLC6 solute carrier 6 transporter protein family | |
| SLC6A1 sodium- and chloride-dependent GABA transporter 1 | 130 |
| SLC6A2 norepinephrine transporter (sodium-dependent noradrenaline transporter) | 127 |
| SLC6A3 sodium-dependent dopamine transporter | 129 |
| SLC6A4 sodium-dependent serotonin transporter | 128 |
| SLC6A5 sodium- and chloride-dependent glycine transporter 1 | 133 |
| SLC6A6 sodium-and chloride-dependent taurine transporter | 136 |
| SLC6A7 sodium-dependent proline transporter | 135 |
| SLC6A8 sodium- and chloride-dependent creatine transporter | 138 |
| SLC6A9 sodium- and chloride-dependent glycine transporter 2 | 134 |
| sodium- and chloride-dependent glycine transporter 1, isoform 2 | 139 |
| sodium- and chloride-dependent glycine transporter 1, isoform 3 | 140 |
| SLC6A10 sodium- and chloride-dependent creatine transporter | 141 |
| SLC6A11 sodium- and chloride-dependent GABA transporter 3 | 132 |
| SLC6A12 sodium- and chloride-dependent betaine transporter | 137 |
| SLC6A13 sodium- and chloride-dependent GABA transporter 2 | 131 |
| SLC6A14 Sodium- and chloride-dependent neutral and basic amino acid transporter B(0+) | 142 |
| SLC6A15 Orphan sodium- and chloride-dependent neurotransmitter transporter NTT73 | 143 |
| SLC6A16 Orphan sodium- and chloride-dependent neurotransmitter transporter NTT5 | 144 |
| SLC6A17 Orphan sodium- and chloride-dependent neurotransmitter transporter NTT4 | 145 |
| SLC6A18 Sodium- and chloride-dependent transporter XTRP2 | 146 |
| SLC6A19 Sodium-dependent neutral amino acid transporter B(0) | 147 |
| SLC6A20 Sodium- and chloride-dependent transporter XTRP3 | 148 |
| Norepinephrine Transporter (NET) | |
| Human Net (hNET) transcript variant 1 (NM_001172504) | 32 |
| Human Net (hNET) transcript variant 2 (NM_001172501) | 33 |
| Human Net (hNET) transcript variant 3 (NM_001043) | 34 |
| Human Net (hNET) transcript variant 4 (NM_001172502) | 35 |
| SLC11 solute carrier 11 transporter protein family | |
| SCL11A2 or hDMT | |
| SLC11A2 transcript variant 4 | 54 |
| SLC11A2 transcript variant 1 | 55 |
| SLC11A2 transcript variant 2 | 56 |
| SLC11A2 transcript variant 3 | 57 |
| SLC11A2 transcript variant 5 | 58 |
| SLC11A2 transcript variant 6 | 59 |
| SLC11A2 transcript variant 7 | 60 |
| SLC43 solute carrier 43 transporter protein family | |
| SLC43A2 | 88 |
| MRI Imaging | |
| Human transferrin receptor hTfR | 44 |
| Human transferrin receptor hTfR | 45 |
| Mouse transferrin receptor mTfR | 46 |
| Human ferritin light chain FTL | 47 |
| Human ferritin heavy chain FTH | 48 |
| FTL 498-499InsTC, a mutated form of the ferritin light chain | 285 |
| Bacterial ferritin ftn | |
| E. coli | 49 |
| E. coli strain K12 | 50 |
| S. aureus strain MRSA252 | 51 |
| S. aureus strain NCTC 8325 | 52 |
| H. pylori B8 | 53 |
| bacterioferritin | 90 |
| codon optimized bacterioferritin | 290 |
| MagA | 280 |
| Enzymes that modify a substrate to produce a detectable product or signal, or are detectable by antibodies | |
| alpha-amylase | 195 |
| alkaline phosphatase | 196 |
| peroxidase | 198 |
| oxidoreductase | 199 |
| pyrophosphatase | 200 |
| Therapeutic genes | |
| Immune modulatory molecules | |
| GM-CSF | 61 |
| MCP-1 (Monocyte Chemoattractant Protein-1) or CCL2 Human | 62 |
| MCP-1 murine | 201 |
| IP-10 or Chemokine ligand 10 (CXCL10) | 66 |
| LIGHT | 281 |
| P60 or SEQSTM1 (Sequestosome 1 transcript variant 1) | 67 |
| P60 or SEQSTM1 (Sequestosome 1 transcript variant 3) | 68 |
| P60 or SEQSTM1 (Sequestosome 1 transcript variant 2) | 69 |
| OspF | 202 |
| OspG | 203 |
| STAT1alpha | 70 |
| STAT1beta | 71 |
| Interleukins | |
| IL-18 (Interleukin-18) | 204 |
| IL-11 (Interleukin-11) | 205 |
| IL-6 (Interleukin-6) | 206 |
| sIL-6R-IL-6 | 16 |
| interleukin-12A | 207 |
| interleukin-1A | 208 |
| interleukin-2 | 209 |
| IL-24 (Interleukin-24) | 15 |
| IL-24 transcript variant 1 | 63 |
| IL-24 transcript variant 4 | 64 |
| IL-24 transcript variant 5 | 65 |
| IL-4 | 210 |

TABLE 66-continued

Heterologous genes

| Detectable gene products | SEQ ID NO |
|---|---|
| IL-8 | 211 |
| IL-10 | 212 |
| chemokines | |
| IP-10 (CXCL) | 66 |
| MIP-2 | 213 |
| Thrombopoietin | 214 |
| RANTES | 215 |
| MIP-1 alpha | 216 |
| MIP-1 beta | 217 |
| CXC chemokines | |
| GROα | 218 |
| GROβ(MIP-2) | 213 |
| GROγ | 219 |
| ENA-78 | 220 |
| LDGF-PPBP | 221 |
| GCP-2 | 222 |
| PF4 | 223 |
| Mig | 224 |
| IP-10 | 66 |
| SDF-1α/β | 225 |
| MIP-1α | 216 |
| MIP-1b | 217 |
| RANTES | 215 |
| Anti-angiogenic genes/angiogenesis inhibitors | |
| Human plasminogen k5 domain (hK5) | 13 |
| PEDF or SERPINF1 (human) | 72 |
| PEDF or SERPINF1 (mouse) | 282 |
| anti-VEGF single chain antibody (G6) | 73 |
| anti-DLL4 single chain antibody GLAF-3 | 302 |
| tTF-RGD | 14 |
| Metastasis suppressor genes | |
| NM23 or NME1 Isoform a or variant 1 | 74 |
| NM23 or NME1 Isoform b or variant 2 | 75 |
| Anti-metastatic genes | |
| E-Cad | 76 |
| Gelsolin | 226 |
| LKB1 (STK11) | 227 |
| RASSF1 | 228 |
| BASSF2 | 229 |
| RASSF3 | 230 |
| RASSF4 | 231 |
| RASSF5 | 232 |
| RASSF6 | 233 |
| RASSF7 | 234 |
| RASSF8 | 235 |
| Syk | 236 |
| TIMP-1 | 237 |
| TIMP-2 | 238 |
| TIMP-3 | 239 |
| TIMP-4 | 240 |
| BRMS-1 | 241 |
| CRMP-1 | 242 |
| CRSP3 | 243 |
| CTGF | 244 |
| DRG1 | 245 |
| KAI1 | 246 |
| KiSS1 (kisspeptin) | 247 |
| Mkk4 | 248 |
| Mkk6 | 249 |
| Mkk7 | 250 |
| RKIP | 251 |
| RHOGDI2 | 252 |
| SSECKS | 253 |
| TXNIP/VDUP1 | 254 |
| Cell matrix-degradative genes | |
| Relaxin 1 | 77 |
| hMMP9 | 78 |
| Hormones | |
| Human Erythropoietin (EPO) | 11 |
| MicroRNAs | |
| pre-miRNA 181a (sequence inserted into viral genome) | 291 |
| miRNA 181a | 292 |
| mmu-miR-181a MIMAT0000210 mature miRNA 181a | 293 |
| pre-miRNA 126 (sequence inserted into the vial genome) | 294 |
| miRNA 126 | 295 |
| hsa-miR-126 MI000471 | 296 |
| hsa-miR-126 MIMAT0000445 | 297 |
| pre-miRNA 335 (sequence inserted into the viral genome) | 298 |
| miRNA 335 | 299 |
| hsa-miR-335 MI0000816 | 300 |
| hsa-miR-335 MIMAT0000765 | 301 |
| Genes for tissue regeneration and reprogramming Human somatic cells to pluripotency | |
| nAG | 255 |
| Oct4 | 256 |
| NANOG | 257 |
| Ngn (Neogenin 1) transcript variant 1 | 79 |
| Ngn (Neogenin 1) transcript variant 2 | 80 |
| Ngn (Neogenin 1) transcript variant 3 | 81 |
| Ngn3 | 258 |
| Pdx1 | 82 |
| Mafa | 83 |
| Additional Genes | |
| Myc-CTR1 | 259 |
| FCU1 | 260 |
| mMnSOD | 287 |
| HACE1 | 261 |
| nppa1 | 262 |
| CPG2 | 263 |
| hADH | 288 |
| WT CDC6 | 264 |
| Mut CDC6 | 328 |
| GLAF-3 | 302 |
| GLAF-4 | 306 |
| GLAF-5 | 310 |
| BMP4 | 265 |
| wildtype F14.5L | 266 |
| Other Proteins | |
| WT1 | 267 |
| p53 | 268 |
| Arf OR p16 | 269 |
| Bax | 270 |
| BRCA1 | 271 |
| cystic fibrosis transmembrane regulator (CFTR) | 272 |
| Factor VIII | 273 |
| low density lipoprotein receptor | 274 |
| alpha-galactosidase | 275 |
| beta-glucocerebrosidase | 276 |
| insulin | 277 |
| parathyroid hormone | 278 |
| alpha-1-antitrypsin | 279 |
| Replacement of the A34R gene with another A34R gene from a different strain in order to increase the EEV form of the virus | |
| A34R gene replaced with the A34R gene from vaccinia IHD-J strain | 286 |

Briefly, a gene cassette is first constructed that contains nucleic acid encoding the heterologous gene operably linked to a vaccinia virus promotor using standard recombinant DNA techniques. The cassette also contains nucleic acid encoding a marker protein operably linked to a vaccinia virus promoter for selection of the recombinant virus. In this Example, the *Escherichia coli* xanthine (guanine) phosphoribosyltransferase (gpt) gene operably linked to the vaccinia virus P7.5 promoter is included in the cassette. The gene cassette is flanked by nucleic acid of the specific restriction endonuclease cleavage site. In this Example, the cassette is flanked by the NotI cleavage site sequence GCGGCCGC (SEQ ID NO: 193). The gene cassette is ligated into a cloning vector for propagation in bacteria.

LIVP viral DNA is prepared and purified according to standard methods (see, e.g., Gross-Bellard et al. (1973) *Eur. J. Biochem.* 36: 32-38). The viral DNA is cleaved with the specific restriction endonuclease, NotI in this Example and purified according to standard methods, such as by phenol/chloroform extraction. The integrity of the LIVP virus vector arms is controlled by field-inversion gel electrophoresis (e.g. 1% agarose gel in 20 mM Tris/10 mM glacial acetic acid/0.5 mM EDTA, pH 8.0; 7 V/cm alternating forward and reverse pulses with 1 sec pause afterwards—1) F6 R3 (4 hr); 2) F4 R2 (4 hr); 3) F2 R1 (4 hr); 4) F8 R4 (8 hr). The gene cassette encoding the heterologous protein and the marker protein is excised from the cloning vector by digestion with NotI and ligated to the preparation of NotI cleaved viral DNA using T4 DNA ligase.

For packaging of the virus, confluent monolayer of African green monkey kidney cell line CV-1 is infected at a M.O.I of 0.5 with a helper virus, fowlpox HP1.441 for 1 hours. The ligated viral DNA is transfected into the infected cells using standard calcium phosphate transfection. After 3 days of incubation, the cells are harvested and crude viral stock is prepared. The viral stock is then used to infect monolayers CV-1 cells under gpt selection (see Issacs, *Vaccinia virus and poxyirology: methods and protocols*, Humana Press (2004)). Virus recombinants incorporating and expressing the *E. coli* gpt gene can form plaques in medium containing mycophenolic acid (MPA, an inhibitor of purine metabolism) and the nucleotide precursors xanthine and hypoxanthine (see Falkner and Moss (1988) *J. Virol.* 62(6): 1849-1854).

B. Homologous Recombination

In this Example, a gene encoding a heterologous protein (set forth in Table 66) is inserted into an LIVP virus, for example, LIVP 1.1.1, 2.1.1, 4.1.1, 5.1.1, 6.1.1, 7.1.1, 8.1.1, and GLV-1h68 (GL-ONC1) by in vivo homologous recombination according to a method similar to that described U.S. Pat. No. 7,588,767, U.S. Pat. Pub. No. 2009-0117034 and Falkner and Moss (1990) J. Virol. 3108-3111. In this method, a gene encoding a heterologous protein is cloned into a shuttle plasmid that targets a particular loci in an LIVP clonal isolate. The gene is then inserted into the genome of the clonal isolate by double reciprocal crossover.

Briefly, a shuttle transfer vector is constructed that contains nucleic acid encoding the heterologous gene is inserted into a plasmid containing a desired segment of vaccinia DNA using standard recombinant DNA techniques. Typically, the DNA is inserted into a non-essential gene, for example, the F14.5, A56R, or HA genes and is linked to a vaccinia promoter. A list of exemplary heterologous proteins is set forth in Table 66 above. The plasmid can also include a dominant selectable marker protein operably linked to a vaccinia virus promoter for selection of the recombinant virus. The shuttle transfer vector is ligated into a cloning vector for propagation in bacteria.

African green monkey kidney fibroblast CV-1 cells (American Type Culture Collection (Manassas, Va.); CCL-70™) are employed for viral generation and production. The cells are grown in Dulbecco's modified Eagle's medium (DMEM) supplemented with 1% antibiotic-antimycotic solution (Mediatech, Inc., Herndon, Va.) and 10% fetal bovine serum (FBS; Mediatech, Inc., Herndon, Va.) at 37° C. under 5% $CO_2$. The CV-1 cells are infected with the LIVP clonal isolate at a MOI. of 0.1 for 1 hr. The infected cells are then transfected using Fugene (Roche, Indianapolis, Ind.) with the shuttle transfer vector. At two days post infection, infected/transfected cells are harvested and the recombinant viruses are selected and plaque purified using standard methods as described previously (Falkner and Moss (1990) *J. Virol.* 64:3108-3111). For example, virus recombinants incorporating and expressing the *E. coli* gpt gene can form plaques in medium containing mycophenolic acid (MPA, an inhibitor of purine metabolism) and the nucleotide precursors xanthine and hypoxanthine (see Falkner and Moss (1988) *J. Virol.* 62(6): 1849-1854).

Example 12

Intravenous Administration of Virus to Human Patients with Advanced Cancer

In this Example, each of LIVP virus 1.1.1, 2.1.1, 4.1.1, 5.1.1, 6.1.1, 7.1.1, 8.1.1 or GLV-1h68 is administered as an intravenous infusion to patients with advanced cancer. Each virus is administered using eight (8) dosing regimes or cohorts over a 28 day cycle and toxicity effects and response determined and compared among the cohorts. There are three patients in each cohort.

For cohorts 1-5, LIVP virus 1.1.1, 2.1.1, 4.1.1, 5.1.1, 6.1.1, 7.1.1, 8.1.1 or GLV-1h68 are administered on day 1 of the 28 day cycle as an intravenous infusion in escalating doses ($1\times10^5$, $1\times10^6$, $1\times10^7$, $1\times10^8$, and $1\times10^9$ pfu, respectively). Cohorts 6-7 receive $1.667\times10^7$ or $1.667\times10^8$ pfu virus, respectively, on days 1-3 of the 28 day cycle. Cohort 8 receives $1\times10^9$ pfu virus for the first five (5) consecutive days of the 28 day cycle. Patients are imaged at baseline and during each cycle on patients with superficial or mucosal lesions. Endpoints also are assessed daily including safety, tolerability, viral replication, tumor delivery, neutralizing antibody development and anti-tumor activity. Toxic effects such as fatigue, fever, rigor myalgia, flu-like symptoms, Vaccinia rash, anemia, oily skin/hair and leukocytosis are assessed. For example, viral plaque assay (VPA) is performed on blood, urine, stool and sputum for viral shedding each day of the cyle.

Patients also are assessed for response to the therapy using RECIST (Response Evaluation Criteria In Solid Tumors; RECIST 1.1, published in January 2009) to determine if the patients improves ("respond"), stay the same ("stabe") or worsen ("progression") during treatments. Patients that have stable disease or partial response continue to receive subsequent cycles of treatment. Patients that have progressive disease are taken off of the trial. If the patient has a complement response, the treatment also will stop and the patient is followed-up and condition monitored.

Example 13

Transcriptional Profiles of Melanoma Host Cell Factors and Early Gene Expression of Oncolytic Vaccinia Virus—Viral Infection and Replication 1. Methods for Transcriptional Analysis and Data Processing Melanoma cell lines 888-MEL and 1936-MEL (well known melanoma cell lines from temporally distinct cutaneous metastases that were derived as described in Sabatino et al. (2008) *Cancer Res.*, 68:122-131 and Monsurro et al. (2010) *J. Transl. Med.*, 8:10; see also e.g., Robbins et al.

(2002) *J. Immunol.*, 169:6036-47; and Wang et al. (2006) *J. Invest. Dermatol.*, 126:1372-7) were infected with vaccinia isolates GLV-1h68, LIVP 1.1.1, LIVP 5.1.1 or LIVP 6.1.1 at a multiplicity of infection (MOI) of 0.01. As a negative control, the cell lines also were treated with virus-free infection medium. After infection, the cells were incubated in cell culture medium at 37° C. for indicated times until harvesting. Cells were harvested at 2, 6, 10, 24 and 48 hours post-infection (hpi). Viral titers were determined by standard plaque assays on CV-1 cell monolayers to determine replication efficiency. Total RNA was isolated, amplified, purified and labeled using standard procedures.

Transcriptional profiles were generated via 36,000 (36 k) human (Wang et al. (2005) *J. transl. Med.*, 3:28) or custom-made vaccinia (VACV) array platforms (VACGLa520445F, Affymetrix, CA; see Worschech et al. (2009) *BMC Genomics*, 10:301). For 36 k human array hybridization, a two color system was used; both reference and test aRNA were directly labeled using ULS™ aRNA Fluorescent Labeling kit (Kreatech Diagnostics, Amsterdam, The Netherlands) with Cy3 for reference and Cy5 for test samples and co-hybridized to the slides. After 20 hour incubation at 42° C. the arrays were washed, dried and scanned using an Agilent scanner. Vaccinia (VACV)-gene expression was assessed by a custom-made VACV array platform (VACG1a520445F; Affymetrix, CA) including 308 probes representing 219 genes that covered the combined genome of several VACV strains, the *Renilla* luciferase-*Aequorea* green fluorescent fusion gene, and 337 human or mouse "housekeeping" genes (393 probes) (see e.g., Worschech et al. (2009) *BMC Genomics,* 10:301) Array quality was documented as previously described (Wang E (2005) *J. Transl. Med.*, 3:28).

6.5 µg aRNA were amplifed from total RNA using the GeneChip® 3' IVT Express Kit (Affymetrix, Santa Clara, Calif.) according to the manufacturer's instructions and hybridized to the chip. After 16 hour incubation in the hybridization oven at 45° C., the arrays were washed and stained in the Fluidics station using the GeneChip® Hybridization, Wash and Stain Kit (Affymetrix). Arrays were scanned using the GeneChip® Scanner 3000 7G (Affymetrix).

Transcriptional data were uploaded to the MicroArray database (mAdb; available at madb.nci.nih.gov or nciarray.nci.nih.gov) and further analyzed using BRBArrayTools developed by the Biometric Research Branch, National Cancer Institute (linus.nci.nih.gov/BRB-ArrayTools.html; see e.g., Jin et al. (2004) *BMC Genomics*, 5:55) or Partek™ Genomics Suite software (St. Louis, Mo.) as appropriate. Gene ratios were average corrected across experimental samples and displayed according to uncentered correlation algorithm. For statistical analysis, the complete dataset expression profile after infection was filtered to include only 95% gene presence and 2-fold change across all experiments (filter 95%, 2-fold) to enrich for informative transcripts. Class comparison was performed using parametric unpaired Student's t test or 3-way ANOVA. Separately, a standard-deviation (STDEV) exlusion/inclusion was also applied to the original gene list (not the pre-filtered one) because standard statistics did not segregate control samples from infected ones. For this, the first filter excluded genes with STDEV >0.25 between controls to eliminate genes differently expressed by cell culture effect not specific for viral infection, and the second filter included gene with STDEV >0.7 (888-MEL) or >0.4 (1936-MEL) to include among the genes selected by the first filtering step only those with high STDEV in infected samples. Gene function interpretation was based on Ingenuity® Pathway Analysis (IPA, Ingenuity® Systems). Data retrieved from the Affymetrix platform was normalized using a Robust Multichip Average (RMA) approach.

2. Results a. Human Gene Transcriptional Changes

Uninfected samples, taken at different times points, segregated together with infected samples according to time in culture (cell culture effect), even after applying standard statistics (ANOVA). Using the STDEV inclusion/exclusion criteria, a list of genes affected by vaccinia virus infection specifically was obtained (see Tables 67 and 68). Specifically, from the designed sequential statistical approaches, 507 and 480 genes were affected by the virus in the 888 and 1936 lines, respectively. After applying a 90% filter, 400 genes were identified that changed in the 888-MEL cell line and 370 genes were identified that changed in the 1936-MEL cell line, and in total 703 human genes were identified that changed specifically due to virus infection. The virus-affected genes were involved in broad cellular functions such as cell death, cellular growth and proliferation, protein synthesis and folding and DNA replication, recombination and repair.

TABLE 67

MEL-1936 Transcriptional Changes (STDEV exclusion/inclusion without filter)

WDR3—WD repeat domain 3 (WDR3), mRNA.
MAFF—v-maf musculoaponeurotic fibrosarcoma oncogene homolog F (avian) (MAFF), transcript variant 1, mRNA.
NUP155—nucleoporin 155 kDa (NUP155), transcript variant 1, mRNA.
VGF—VGF nerve growth factor inducible (VGF), mRNA.
CDH24—cadherin 24, type 2 (CDH24), transcript variant 2, mRNA.
DNAJB13—DnaJ (Hsp40) homolog, subfamily B, member 13 (DNAJB13), mRNA.
MYCN—v-myc myelocytomatosis viral related oncogene, neuroblastoma derived (avian) (MYCN), mRNA.
PLEKHO2—pleckstrin homology domain containing, family O member 2 (PLEKHO2), transcript variant 2, mRNA.
RXRA—retinoid X receptor, alpha (RXRA), mRNA.
GTSE1—G-2 and S-phase expressed 1
KIAA0913—KIAA0913
ARL10—ADP-ribosylation factor-like 10 (ARL10), mRNA.
HLA-DPB1—major histocompatibility complex, class II, DP beta 1 (HLA-DPB1), mRNA.
PNPLA6—Patatin-like phospholipase domain containing 6
DOCK6—dedicator of cytokinesis 6 (DOCK6), mRNA.
ZNF238—zinc finger protein 238 (ZNF238), transcript variant 1, mRNA.
KIAA1683—KIAA1683 (KIAA1683), transcript variant 2, mRNA.
ANK3—ankyrin 3, node of Ranvier (ankyrin G) (ANK3), transcript variant 1, mRNA.

TABLE 67-continued

MEL-1936 Transcriptional Changes (STDEV exclusion/inclusion without filter)

MRPL9—mitochondrial ribosomal protein L9 (MRPL9), nuclear gene encoding mitochondrial protein, mRNA.
MARCKS—myristoylated alanine-rich protein kinase C substrate (MARCKS), mRNA.
TBC1D9B—TBC1 domain family, member 9B (with GRAM domain) (TBC1D9B), transcript variant 2, mRNA.
--Transcribed locus, strongly similar to NP_113751.3 nuclease-sensitive element-binding protein 1 [*Rattus norvegicus*]
RILPL1—Rab interacting lysosomal protein-like 1 (RILPL1), mRNA.
ZDHHC8P1—zinc finger, DHHC-type containing 8 pseudogene 1 (ZDHHC8P1), non-coding RNA.
LOC390282—PREDICTED: similar to hCG2040283 (LOC390282), mRNA.
BEX1—brain expressed, X-linked 1 (BEX1), mRNA.
UNC13B—unc-13 homolog B (*C. elegans*) (UNC13B), mRNA.
YY1—YY1 transcription factor (YY1), mRNA.
BAX—BCL2-associated X protein (BAX), transcript variant alpha, mRNA.
INTS3—integrator complex subunit 3 (INTS3), mRNA.
WDR74—WD repeat domain 74 (WDR74), mRNA.
PPPDE2—PPPDE peptidase domain containing 2 (PPPDE2), mRNA.
PARP9—poly (ADP-ribose) polymerase family, member 9 (PARP9), transcript variant 2, mRNA.
LOC80154—hypothetical LOC80154 (LOC80154), non-coding RNA.
YIPF4—Yip1 domain family, member 4 (YIPF4), mRNA.
SLC25A4—solute carrier family 25 (mitochondrial carrier; adenine nucleotide translocator), member 4 (SLC25A4), nuclear gene encoding mitochondrial protein, mRNA.
CSRNP2—cysteine-serine-rich nuclear protein 2 (CSRNP2), mRNA.
PDLIM7—PDZ and LIM domain 7 (enigma) (PDLIM7), transcript variant 4, mRNA.
BCAR1—breast cancer anti-estrogen resistance 1 (BCAR1), transcript variant 2, mRNA.
CCDC85C—coiled-coil domain containing 85C (CCDC85C), mRNA.
SCAMP3—secretory carrier membrane protein 3 (SCAMP3), transcript variant 2, mRNA.
ADPRHL2—ADP-ribosylhydrolase like 2 (ADPRHL2), nuclear gene encoding mitochondrial protein, mRNA.
POLDIP2—polymerase (DNA-directed), delta interacting protein 2 (POLDIP2), mRNA.
SIGMAR1—sigma non-opioid intracellular receptor 1 (SIGMAR1), transcript variant 1, mRNA.
PKM2—pyruvate kinase, muscle (PKM2), transcript variant 2, mRNA.
C1orf106—chromosome 1 open reading frame 106 (C1orf106), transcript variant 1, mRNA.
AKT2—v-akt murine thymoma viral oncogene homolog 2 (AKT2), mRNA.
POLR2A—polymerase (RNA) II (DNA directed) polypeptide A, 220 kDa (POLR2A), mRNA.
CAPN2—calpain 2, (m/II) large subunit (CAPN2), transcript variant 1, mRNA.
APEH—N-acylaminoacyl-peptide hydrolase (APEH), mRNA.
CEP55—centrosomal protein 55 kDa (CEP55), transcript variant 1, mRNA.
PLK1—polo-like kinase 1 (PLK1), mRNA.
DHX9—DEAH (Asp-Glu-Ala-His) box polypeptide 9 (DHX9), transcript variant 1, mRNA.
TUSC2—tumor suppressor candidate 2 (TUSC2), mRNA.
GEMIN5—gem (nuclear organelle) associated protein 5 (GEMIN5), mRNA.
PPP1CC—protein phosphatase 1, catalytic subunit, gamma isozyme (PPP1CC), mRNA.
TAF11—TAF11 RNA polymerase II, TATA box binding protein (TBP)-associated factor, 28 kDa (TAF11), mRNA.
CTBP2—C-terminal binding protein 2 (CTBP2), transcript variant 1, mRNA.
CANX—calnexin (CANX), transcript variant 2, mRNA.
TCEB2—transcription elongation factor B (SIII), polypeptide 2 (18 kDa, elongin B) (TCEB2), transcript variant 1, mRNA.
HMGB3—high-mobility group box 3 (HMGB3), mRNA.
ADRM1—adhesion regulating molecule 1 (ADRM1), transcript variant 2, mRNA.
SIVA1—SIVA1, apoptosis-inducing factor (SIVA1), transcript variant 1, mRNA.
C2orf7—chromosome 2 open reading frame 7 (C2orf7), mRNA.
TRAM1—translocation associated membrane protein 1 (TRAM1), mRNA.
ATIC—5-aminoimidazole-4-carboxamide ribonucleotide formyltransferase/IMP cyclohydrolase (ATIC), mRNA.
MRPS26—mitochondrial ribosomal protein S26 (MRPS26), nuclear gene encoding mitochondrial protein, mRNA.
GSPT1—G1 to S phase transition 1 (GSPT1), transcript variant 2, mRNA.
LRP3—low density lipoprotein receptor-related protein 3 (LRP3), mRNA.
STAR—steroidogenic acute regulatory protein (STAR), nuclear gene encoding mitochondrial protein, mRNA.
COQ4—coenzyme Q4 homolog (*S. cerevisiae*) (COQ4), nuclear gene encoding mitochondrial protein, mRNA.
ABCB6—ATP-binding cassette, sub-family B (MDR/TAP), member 6 (ABCB6), nuclear gene encoding mitochondrial protein, mRNA.
LAPTM4B—lysosomal protein transmembrane 4 beta (LAPTM4B), mRNA.
ACAA2—acetyl-CoA acyltransferase 2 (ACAA2), nuclear gene encoding mitochondrial protein, mRNA.
UROS—uroporphyrinogen III synthase (UROS), mRNA.
C20orf3—chromosome 20 open reading frame 3 (C20orf3), mRNA.
IARS2—isoleucyl-tRNA synthetase 2, mitochondrial (IARS2), nuclear gene encoding mitochondrial protein, mRNA.
TACO1—translational activator of mitochondrially encoded cytochrome c oxidase I (TACO1), nuclear gene encoding mitochondrial protein, mRNA.
CENPV—centromere protein V (CENPV), mRNA.
DGCR2—DiGeorge syndrome critical region gene 2 (DGCR2), transcript variant 3, mRNA.
NOC4L—nucleolar complex associated 4 homolog (*S. cerevisiae*) (NOC4L), mRNA.

TABLE 67-continued

MEL-1936 Transcriptional Changes (STDEV exclusion/inclusion without filter)

PUF60—poly-U binding splicing factor 60 KDa (PUF60), transcript variant 2, mRNA.
PDCD6—programmed cell death 6 (PDCD6), mRNA.
C7orf42—chromosome 7 open reading frame 42 (C7orf42), mRNA.
YWHAB—tyrosine 3-monooxygenase/tryptophan 5-monooxygenase activation protein, beta polypeptide (YWHAB), transcript variant 2, mRNA.
CUL1—cullin 1 (CUL1), mRNA.
GLT25D1—glycosyltransferase 25 domain containing 1 (GLT25D1), mRNA.
FIBP—fibroblast growth factor (acidic) intracellular binding protein (FIBP), transcript variant 2, mRNA.
WDR18—WD repeat domain 18 (WDR18), mRNA.
KEAP1—kelch-like ECH-associated protein 1 (KEAP1), transcript variant 2, mRNA.
POLR2E—polymerase (RNA) II (DNA directed) polypeptide E, 25 kDa (POLR2E), mRNA.
ATP5A1—ATP synthase, H+ transporting, mitochondrial F1 complex, alpha subunit 1, cardiac muscle (ATP5A1), nuclear gene encoding mitochondrial protein, transcript variant 2, mRNA.
NUCKS1—Nuclear casein kinase and cyclin-dependent kinase substrate 1
IQSEC3—IQ motif and Sec7 domain 3 (IQSEC3), transcript variant 1, mRNA.
SOCS2—suppressor of cytokine signaling 2 (SOCS2), mRNA.
NCOA5—nuclear receptor coactivator 5 (NCOA5), mRNA.
ATP5B—ATP synthase, H+ transporting, mitochondrial F1 complex, beta polypeptide (ATP5B), nuclear gene encoding mitochondrial protein, mRNA.
ALDH3A2—aldehyde dehydrogenase 3 family, member A2 (ALDH3A2), transcript variant 2, mRNA.
EIF3J—eukaryotic translation initiation factor 3, subunit J (EIF3J), mRNA.
MRFAP1—Mof4 family associated protein 1 (MRFAP1), mRNA.
PKMYT1—protein kinase, membrane associated tyrosine/threonine 1 (PKMYT1), transcript variant 1, mRNA.
SNRPC—small nuclear ribonucleoprotein polypeptide C (SNRPC), transcript variant 1, mRNA.
CD320—CD320 molecule (CD320), transcript variant 1, mRNA.
GALK1—galactokinase 1 (GALK1), mRNA.
PDF—peptide deformylase (mitochondrial) (PDF), nuclear gene encoding mitochondrial protein, mRNA.
SRD5A1—steroid-5-alpha-reductase, alpha polypeptide 1 (3-oxo-5 alpha-steroid delta 4-dehydrogenase alpha 1) (SRD5A1), mRNA.
LANCL2—LanC lantibiotic synthetase component C-like 2 (bacterial) (LANCL2), mRNA.
CETN2—centrin, EF-hand protein, 2 (CETN2), mRNA.
DNAJA2—DnaJ (Hsp40) homolog, subfamily A, member 2 (DNAJA2), mRNA.
ALDH7A1—aldehyde dehydrogenase 7 family, member A1 (ALDH7A1), mRNA.
PREP—prolyl endopeptidase (PREP), mRNA.
GNA11—guanine nucleotide binding protein (G protein), alpha 11 (Gq class) (GNA11), mRNA.
GYS1—glycogen synthase 1 (muscle) (GYS1), transcript variant 1, mRNA.
MTP18—mitochondrial protein 18 kDa (MTP18), nuclear gene encoding mitochondrial protein, transcript variant 1, mRNA.
DCXR—dicarbonyl/L-xylulose reductase (DCXR), transcript variant 2, mRNA.
PABPC4—poly(A) binding protein, cytoplasmic 4 (inducible form) (PABPC4), transcript variant 2, mRNA.
CDK4—cyclin-dependent kinase 4 (CDK4), mRNA.
ARFIP2—ADP-ribosylation factor interacting protein 2 (ARFIP2), mRNA.
ARHGEF10—Rho guanine nucleotide exchange factor (GEF) 10 (ARHGEF10), mRNA.
PTDSS1—phosphatidylserine synthase 1 (PTDSS1), mRNA.
SAMM50—sorting and assembly machinery component 50 homolog (S. cerevisiae) (SAMM50), mRNA.
KIAA2013—KIAA2013
IRAK1—interleukin-1 receptor-associated kinase 1 (IRAK1), transcript variant 2, mRNA.
PWP2—PWP2 periodic tryptophan protein homolog (yeast) (PWP2), mRNA.
CSK—c-src tyrosine kinase (CSK), transcript variant 2, mRNA.
MRPS2—mitochondrial ribosomal protein S2 (MRPS2), nuclear gene encoding mitochondrial protein, mRNA.
NDUFAF3—NADH dehydrogenase (ubiquinone) 1 alpha subcomplex, assembly factor 3 (NDUFAF3), nuclear gene encoding mitochondrial protein, transcript variant 2, mRNA.
CARS2—cysteinyl-tRNA synthetase 2, mitochondrial (putative) (CARS2), nuclear gene encoding mitochondrial protein, mRNA.
PSMD2—proteasome (prosome, macropain) 26S subunit, non-ATPase, 2 (PSMD2), mRNA.
ACTB—actin, beta (ACTB), mRNA.
LYN—v-yes-1 Yamaguchi sarcoma viral related oncogene homolog (LYN), transcript variant 2, mRNA.
HSD17B10—hydroxysteroid (17-beta) dehydrogenase 10 (HSD17B10), nuclear gene encoding mitochondrial protein, transcript variant 2, mRNA.
C9orf140—chromosome 9 open reading frame 140 (C9orf140), mRNA.
PLK1—polo-like kinase 1 (PLK1), mRNA.
RUVBL2—RuvB-like 2 (E. coli) (RUVBL2), mRNA.
TSEN54—tRNA splicing endonuclease 54 homolog (S. cerevisiae) (TSEN54), mRNA.
EPHB4—EPH receptor B4 (EPHB4), mRNA.
ADCY3—adenylate cyclase 3 (ADCY3), mRNA.
HNRNPL—heterogeneous nuclear ribonucleoprotein L (HNRNPL), transcript variant 1, mRNA.
CECR5—cat eye syndrome chromosome region, candidate 5 (CECR5), transcript variant 1, mRNA.
HNRNPM—heterogeneous nuclear ribonucleoprotein M (HNRNPM), transcript variant 2, mRNA.
CRIP2—cysteine-rich protein 2 (CRIP2), mRNA.
TAX1BP3—Tax1 (human T-cell leukemia virus type I) binding protein 3 (TAX1BP3), mRNA.
CDK2AP1—cyclin-dependent kinase 2 associated protein 1 (CDK2AP1), mRNA.
NT5DC2—5'-nucleotidase domain containing 2 (NT5DC2), transcript variant 1, mRNA.
C8orf55—chromosome 8 open reading frame 55 (C8orf55), mRNA.
AKAP8—A kinase (PRKA) anchor protein 8 (AKAP8), mRNA.

TABLE 67-continued

MEL-1936 Transcriptional Changes (STDEV exclusion/inclusion without filter)

ENTPD6—ectonucleoside triphosphate diphosphohydrolase 6 (putative) (ENTPD6), transcript variant 2, mRNA.
HYAL2—hyaluronoglucosaminidase 2 (HYAL2), transcript variant 2, mRNA.
MYH10—myosin, heavy chain 10, non-muscle (MYH10), mRNA.
B3GALT6—UDP-Gal:betaGal beta 1,3-galactosyltransferase polypeptide 6 (B3GALT6), mRNA.
C19orf43—chromosome 19 open reading frame 43 (C19orf43), mRNA.
PDCD2—programmed cell death 2 (PDCD2), transcript variant 1, mRNA.
FEM1A—fem-1 homolog a (*C. elegans*) (FEM1A), mRNA.
LUC7L3—LUC7-like 3 (*S. cerevisiae*)
TAF4B—TAF4b RNA polymerase II, TATA box binding protein (TBP)-associated factor, 105 kDa (TAF4B), mRNA.
LOC119358—PREDICTED: similar to hCG2040270 (LOC119358), mRNA.
C18orf22—chromosome 18 open reading frame 22 (C18orf22), nuclear gene encoding mitochondrial protein, transcript variant 2, mRNA.
ANAPC13—anaphase promoting complex subunit 13 (ANAPC13), transcript variant 1, mRNA.
KHSRP—KH-type splicing regulatory protein (KHSRP), mRNA.
C16orf75—chromosome 16 open reading frame 75 (C16orf75), mRNA.
SLC25A3—solute carrier family 25 (mitochondrial carrier; phosphate carrier), member 3 (SLC25A3), nuclear gene encoding mitochondrial protein, transcript variant 3, mRNA.
MRPL45—mitochondrial ribosomal protein L45 (MRPL45), nuclear gene encoding mitochondrial protein, mRNA.
SLC10A3—solute carrier family 10 (sodium/bile acid cotransporter family), member 3 (SLC10A3), transcript variant 3, mRNA.
PATZ1—POZ (BTB) and AT hook containing zinc finger 1 (PATZ1), transcript variant 3, mRNA.
HMBS—hydroxymethylbilane synthase (HMBS), transcript variant 2, mRNA.
ASB13—ankyrin repeat and SOCS box-containing 13 (ASB13), transcript variant 1, mRNA.
IMPA2—inositol(myo)-1(or 4)-monophosphatase 2 (IMPA2), mRNA.
CKB—creatine kinase, brain (CKB), mRNA.
SLC8A2—solute carrier family 8 (sodium/calcium exchanger), member 2 (SLC8A2), mRNA.
TXNRD3—thioredoxin reductase 3 (TXNRD3), transcript variant 1, mRNA.
HARS—histidyl-tRNA synthetase (HARS), mRNA.
C2orf28—chromosome 2 open reading frame 28 (C2orf28), transcript variant 1, mRNA.
STOML2—stomatin (EPB72)-like 2 (STOML2), mRNA.
C17orf85—chromosome 17 open reading frame 85 (C17orf85), transcript variant 1, mRNA.
SHROOM3—shroom family member 3 (SHROOM3), mRNA.
RAVER2—ribonucleoprotein, PTB-binding 2 (RAVER2), mRNA.
CHCHD4—coiled-coil-helix-coiled-coil-helix domain containing 4 (CHCHD4), nuclear gene encoding mitochondrial protein, transcript variant 1, mRNA.
ANKRD54—ankyrin repeat domain 54 (ANKRD54), transcript variant 1, mRNA.
LOC100130894—hypothetical LOC100130894 (LOC100130894), non-coding RNA.
BTF3L3—Basic transcription factor 3, like 3
TMEM107—transmembrane protein 107 (TMEM107), transcript variant 2, mRNA.
WBP2—WW domain binding protein 2 (WBP2), mRNA.
CSDA—cold shock domain protein A (CSDA), transcript variant 1, mRNA.
HLA-J—major histocompatibility complex, class I, J (pseudogene) (HLA-J), non-coding RNA.
RFPL1—ret finger protein-like 1 (RFPL1), mRNA.
ANPEP—alanyl (membrane) aminopeptidase (ANPEP), mRNA.
ASXL2—Additional sex combs like 2 (*Drosophila*)
CSNK1G2—casein kinase 1, gamma 2 (CSNK1G2), mRNA.
RPL27—ribosomal protein L27 (RPL27), mRNA.
RPL10—ribosomal protein L10 (RPL10), transcript variant 1, mRNA.
PTPN9—protein tyrosine phosphatase, non-receptor type 9 (PTPN9), mRNA.
RABL2B—RAB, member of RAS oncogene family-like 2B (RABL2B), transcript variant 5, mRNA.
TRIM11—Tripartite motif-containing 11
RPL6—ribosomal protein L6 (RPL6), transcript variant 1, mRNA.
MXD1—MAX dimerization protein 1 (MXD1), mRNA.
HLA-DRB5—major histocompatibility complex, class II, DR beta 5 (HLA-DRB5), mRNA.
PSMB9—proteasome (prosome, macropain) subunit, beta type, 9 (large multifunctional peptidase 2) (PSMB9), mRNA.
HLA-DRB3—major histocompatibility complex, class II, DR beta 3 (HLA-DRB3), mRNA.
TNFAIP3—tumor necrosis factor, alpha-induced protein 3 (TNFAIP3), mRNA.
IGKC—Immunoglobulin kappa constant
ID2—inhibitor of DNA binding 2, dominant negative helix-loop-helix protein (ID2), mRNA.
HES1—hairy and enhancer of split 1, (*Drosophila*) (HES1), mRNA.
LOC100132984—Hypothetical protein LOC100132984
ZNF706—zinc finger protein 706 (ZNF706), transcript variant 3, mRNA.
NCRNA00183—Non-protein coding RNA 183
PDZD11—PDZ domain containing 11 (PDZD11), mRNA.
C1orf147—PREDICTED: chromosome 1 open reading frame 147 (C1orf147), miscRNA.
RIPK2—receptor-interacting serine-threonine kinase 2 (RIPK2), mRNA.
ISG20—interferon stimulated exonuclease gene 20 kDa (ISG20), mRNA.
HLA-L—major histocompatibility complex, class I, L, pseudogene (HLA-L), non-coding RNA.
FTSJD2—FtsJ methyltransferase domain containing 2
LCP1—lymphocyte cytosolic protein 1 (L-plastin) (LCP1), mRNA.
SYNGR3—synaptogyrin 3 (SYNGR3), mRNA.
MAP1LC3B2—microtubule-associated protein 1 light chain 3 beta 2 (MAP1LC3B2), mRNA.
ANKRD13D—ankyrin repeat domain 13 family, member D (ANKRD13D), transcript variant 1, mRNA.
IDS—iduronate 2-sulfatase (IDS), transcript variant 1, mRNA.

TABLE 67-continued

MEL-1936 Transcriptional Changes (STDEV exclusion/inclusion without filter)

DPY19L2P2—dpy-19-like 2 pseudogene 2 (*C. elegans*) (DPY19L2P2), transcript variant 2, non-coding RNA.
BCYRN1—brain cytoplasmic RNA 1 (non-protein coding) (BCYRN1), non-coding RNA.
ZNF492—zinc finger protein 492 (ZNF492), mRNA.
LCK—lymphocyte-specific protein tyrosine kinase (LCK), transcript variant 1, mRNA.
HSPA1B—heat shock 70 kDa protein 1B (HSPA1B), mRNA.
LILRA2—leukocyte immunoglobulin-like receptor, subfamily A (with TM domain), member 2 (LILRA2), transcript variant 2, mRNA.
HLA-H—major histocompatibility complex, class I, H (pseudogene) (HLA-H), non-coding RNA.
IL7R—interleukin 7 receptor (IL7R), mRNA.
GMFG—Glia maturation factor, gamma
LGALS2—lectin, galactoside-binding, soluble, 2 (LGALS2), mRNA.
CCL5—chemokine (C-C motif) ligand 5 (CCL5), mRNA.
FAM65B—family with sequence similarity 65, member B (FAM65B), transcript variant 2, mRNA.
DENND1C—DENN/MADD domain containing 1C (DENND1C), mRNA.
MYST3—MYST histone acetyltransferase (monocytic leukemia) 3 (MYST3), transcript variant 3, mRNA.
FCGR3B—Fc fragment of IgG, low affinity IIIb, receptor (CD16b) (FCGR3B), mRNA.
RGS2—regulator of G-protein signaling 2, 24 kDa (RGS2), mRNA.
CARD16—caspase recruitment domain family, member 16 (CARD16), transcript variant 1, mRNA.
PLXDC2—plexin domain containing 2 (PLXDC2), mRNA.
CLC—Charcot-Leyden crystal protein (CLC), mRNA.
AOAH—acyloxyacyl hydrolase (neutrophil) (AOAH), transcript variant 2, mRNA.
GPR183—G protein-coupled receptor 183 (GPR183), mRNA.
TRPM2—transient receptor potential cation channel, subfamily M, member 2 (TRPM2), mRNA.
MMP25—matrix metallopeptidase 25 (MMP25), mRNA.
LDLRAD2—low density lipoprotein receptor class A domain containing 2 (LDLRAD2), mRNA.
C8orf51—chromosome 8 open reading frame 51 (C8orf51), non-coding RNA.
TUBB3—tubulin, beta 3 (TUBB3), mRNA.
LOC729213—PREDICTED: similar to ectonucleotide pyrophosphatase/phosphodiesterase 5 (putative function) (LOC729213), mRNA.
ZNF532—Zinc finger protein 532
MGC23270—hypothetical LOC196872 (MGC23270), non-coding RNA.
AHCY—adenosylhomocysteinase (AHCY), transcript variant 1, mRNA.
FLJ46838—PREDICTED: FLJ46838 protein (FLJ46838), miscRNA.
HLA-DMA—major histocompatibility complex, class II, DM alpha (HLA-DMA), mRNA.
C1orf91—Chromosome 1 open reading frame 91
DCP1A—DCP1 decapping enzyme homolog A (*S. cerevisiae*) (DCP1A), mRNA.
ARC—activity-regulated cytoskeleton-associated protein (ARC), mRNA.
CHN2—chimerin (chimaerin) 2 (CHN2), transcript variant 2, mRNA.
RN18S1—RNA, 18S ribosomal 1 (RN18S1), ribosomal RNA.
UPK3A—uroplakin 3A (UPK3A), transcript variant 2, mRNA.
MBD3L5—methyl-CpG-binding domain protein 3-like 5-like (MBD3L5), mRNA.
HIST2H3C—histone cluster 2, H3c (HIST2H3C), mRNA.
HIST2H3D—histone cluster 2, H3d (HIST2H3D), mRNA.
ZFAND2A—zinc finger, AN1-type domain 2A (ZFAND2A), mRNA.
MICAL3—microtubule associated monoxygenase, calponin and LIM domain containing 3 (MICAL3), transcript variant 2, mRNA.
--*Homo sapiens*, clone IMAGE: 3862165, mRNA
ZNF354B—Zinc finger protein 354B
CEBPB—CCAAT/enhancer binding protein (C/EBP), beta (CEBPB), mRNA.
LTB4R—leukotriene B4 receptor (LTB4R), transcript variant 2, mRNA.
RN28S1—RNA, 28S ribosomal 1 (RN28S1), ribosomal RNA.
HIST1H3D—histone cluster 1, H3d (HIST1H3D), mRNA.
FLJ31662—hypothetical LOC440594 (FLJ31662), non-coding RNA.
MLL5—myeloid/lymphoid or mixed-lineage leukemia 5 (trithorax homolog, *Drosophila*) (MLL5), transcript variant 2, mRNA.
CALB2—calbindin 2 (CALB2), transcript variant CALB2c, mRNA.
IER5—immediate early response 5 (IER5), mRNA.
SLC38A9—Solute carrier family 38, member 9
AFF1—AF4/FMR2 family, member 1
C8orf79—chromosome 8 open reading frame 79 (C8orf79), transcript variant 2, mRNA.
ABCA4—ATP-binding cassette, sub-family A (ABC1), member 4 (ABCA4), mRNA.
TUBB2B—tubulin, beta 2B (TUBB2B), mRNA.
SULT4A1—sulfotransferase family 4A, member 1 (SULT4A1), mRNA.
HELLS—Helicase, lymphoid-specific
TBL2—transducin (beta)-like 2 (TBL2), mRNA.
GPN3—GPN-loop GTPase 3 (GPN3), transcript variant 2, mRNA.
HMGB1—high-mobility group box 1 (HMGB1), mRNA.
TPTE2P2—transmembrane phosphoinositide 3-phosphatase and tensin homolog 2 pseudogene 2 (TPTE2P2), non-coding RNA.
TPTE2P2—transmembrane phosphoinositide 3-phosphatase and tensin homolog 2 pseudogene 2 (TPTE2P2), non-coding RNA.
H2BFS—H2B histone family, member S
ALAS2—aminolevulinate, delta-, synthase 2 (ALAS2), nuclear gene encoding mitochondrial protein, transcript variant 3, mRNA.
PHF10—PHD finger protein 10
LOC150519—PREDICTED: hypothetical LOC150519 (LOC150519), miscRNA.

TABLE 67-continued

MEL-1936 Transcriptional Changes (STDEV exclusion/inclusion without filter)

RNF175—ring finger protein 175 (RNF175), mRNA.
S100A11P—S100 CALCIUM-BINDING PROTEIN A14
BRWD1—bromodomain and WD repeat domain containing 1 (BRWD1), transcript variant 2, mRNA.
DUSP6—dual specificity phosphatase 6 (DUSP6), transcript variant 1, mRNA.
CITED2—Cbp/p300-interacting transactivator, with Glu/Asp-rich carboxy-terminal domain, 2 (CITED2), transcript variant 1, mRNA.
FBLN1—fibulin 1 (FBLN1), transcript variant C, mRNA.
SNX17—sorting nexin 17 (SNX17), mRNA.
CTBP1—C-terminal binding protein 1 (CTBP1), transcript variant 2, mRNA.
REEP6—receptor accessory protein 6 (REEP6), mRNA.
ZC3H4—zinc finger CCCH-type containing 4 (ZC3H4), mRNA.
BCKDK—branched chain ketoacid dehydrogenase kinase (BCKDK), nuclear gene encoding mitochondrial protein, transcript variant 1, mRNA.
UBA1—ubiquitin-like modifier activating enzyme 1 (UBA1), transcript variant 2, mRNA.
CBX1—chromobox homolog 1 (CBX1), transcript variant 1, mRNA.
CBX5—chromobox homolog 5 (CBX5), transcript variant 3, mRNA.
NUBP2—nucleotide binding protein 2 (MinD homolog, *E. coli*) (NUBP2), mRNA.
NFIC—nuclear factor I/C (CCAAT-binding transcription factor) (NFIC), transcript variant 2, mRNA.
EP400—E1A binding protein p400 (EP400), mRNA.
WDR6—WD repeat domain 6 (WDR6), mRNA.
CHCHD10—coiled-coil-helix-coiled-coil-helix domain containing 10 (CHCHD10), mRNA.
CD81—CD81 molecule (CD81), mRNA.
GRB2—growth factor receptor-bound protein 2 (GRB2), transcript variant 2, mRNA.
XPOT—exportin, tRNA (nuclear export receptor for tRNAs) (XPOT), mRNA.
TFPT—TCF3 (E2A) fusion partner (in childhood Leukemia) (TFPT), mRNA.
OBSL1—obscurin-like 1 (OBSL1), transcript variant 3, mRNA.
C8orf85—chromosome 8 open reading frame 85 (C8orf85), mRNA.
TMED1—transmembrane emp24 protein transport domain containing 1 (TMED1), mRNA.
NOMO1—NODAL modulator 1 (NOMO1), mRNA.
CDT1—chromatin licensing and DNA replication factor 1 (CDT1), mRNA.
ARID5B—AT rich interactive domain 5B (MRF1-like) (ARID5B), mRNA.
MGAT4B—mannosyl (alpha-1,3-)-glycoprotein beta-1,4-N-acetylglucosaminyltransferase, isozyme B (MGAT4B), transcript variant 2, mRNA.
ATP5D—ATP synthase, H+ transporting, mitochondrial F1 complex, delta subunit (ATP5D), nuclear gene encoding mitochondrial protein, transcript variant 1, mRNA.
P4HB—prolyl 4-hydroxylase, beta polypeptide (P4HB), mRNA.
PHB2—prohibitin 2 (PHB2), transcript variant 2, mRNA.
EFHD1—EF-hand domain family, member D1 (EFHD1), transcript variant 1, mRNA.
PTGES2—prostaglandin E synthase 2 (PTGES2), transcript variant 1, mRNA.
AMZ2—archaelysin family metallopeptidase 2 (AMZ2), transcript variant 6, mRNA.
EIF4EBP2—eukaryotic translation initiation factor 4E binding protein 2 (EIF4EBP2), mRNA.
TMEM203—transmembrane protein 203 (TMEM203), mRNA.
DHTKD1—dehydrogenase E1 and transketolase domain containing 1 (DHTKD1), nuclear gene encoding mitochondrial protein, mRNA.
RTN2—reticulon 2 (RTN2), transcript variant 3, mRNA.
CCNB2—cyclin B2 (CCNB2), mRNA.
POP7—processing of precursor 7, ribonuclease P/MRP subunit (*S. cerevisiae*) (POP7), mRNA.
FAM162A—family with sequence similarity 162, member A (FAM162A), mRNA.
YTHDF2—YTH domain family, member 2 (YTHDF2), transcript variant 3, mRNA.
LOC152217—hypothetical LOC152217 (LOC152217), non-coding RNA.
RAB24—RAB24, member RAS oncogene family (RAB24), transcript variant 1, mRNA.
C9orf86—chromosome 9 open reading frame 86 (C9orf86), transcript variant 1, mRNA.
FAM57A—family with sequence similarity 57, member A (FAM57A), mRNA.
AKR7A2—aldo-keto reductase family 7, member A2 (aflatoxin aldehyde reductase) (AKR7A2), mRNA.
TNPO1—transportin 1 (TNPO1), transcript variant 2, mRNA.
GHITM—growth hormone inducible transmembrane protein (GHITM), mRNA.
HSPBP1—HSPA (heat shock 70 kDa) binding protein, cytoplasmic cochaperone 1 (HSPBP1), transcript variant 2, mRNA.
PRELID2—PRELI domain containing 2 (PRELID2), transcript variant 1, mRNA.
C1orf43—chromosome 1 open reading frame 43 (C1orf43), transcript variant 2, mRNA.
PPM1B—protein phosphatase, Mg2+/Mn2+ dependent, 1B (PPM1B), transcript variant 3, mRNA.
SARS—seryl-tRNA synthetase (SARS), transcript variant 1, mRNA.
RPL37A—ribosomal protein L37a (RPL37A), mRNA.
—FBI Forensic mitochondrial DNA sequence control region 1 (Anderson HV 1)
HNRNPA1—heterogeneous nuclear ribonucleoprotein A1 (HNRNPA1), transcript variant 1, mRNA.
PHPT1—phosphohistidine phosphatase 1 (PHPT1), transcript variant 3, mRNA.
hsa-mir-214—Homo sapiens microRNA miR-214 stem-loop
--Transcribed locus, moderately similar to NP_001164551.1 RNA-binding protein 41 isoform 2 [*Homo sapiens*]
ZBTB1—zinc finger and BTB domain containing 1 (ZBTB1), transcript variant 2, mRNA.
SHROOM4—shroom family member 4 (SHROOM4), transcript variant 1, mRNA.
MLC1—megalencephalic leukoencephalopathy with subcortical cysts 1 (MLC1), transcript variant 2, mRNA.
HSD3B7—Hydroxy-delta-5-steroid dehydrogenase, 3 beta- and steroid delta-isomerase 7
LCE2A—late cornified envelope 2A (LCE2A), mRNA.
KRTAP10-2—keratin associated protein 10-2 (KRTAP10-2), mRNA.
SLC22A18—solute carrier family 22, member 18 (SLC22A18), transcript variant 1, mRNA.
LOC388796—hypothetical LOC388796 (LOC388796), transcript variant 1, non-coding RNA.

TABLE 67-continued

MEL-1936 Transcriptional Changes (STDEV exclusion/inclusion without filter)

M6PR—mannose-6-phosphate receptor (cation dependent) (M6PR), mRNA.
XP_945475.1—PREDICTED: similar to ribosomal protein S3a [Source: RefSeq_peptide_predicted; Acc: XP_940681]
RPL6—ribosomal protein L6 (RPL6), transcript variant 1, mRNA.
TMPRSS4—transmembrane protease, serine 4 (TMPRSS4), transcript variant 5, mRNA.
GNG5—guanine nucleotide binding protein (G protein), gamma 5 (GNG5), mRNA.
TMEM134—transmembrane protein 134 (TMEM134), transcript variant 2, mRNA.
RPL12—ribosomal protein L12 (RPL12), mRNA.
RPS10—ribosomal protein S10 (RPS10), mRNA.
SLC2A13—solute carrier family 2 (facilitated glucose transporter), member 13 (SLC2A13), mRNA.
SHPK—sedoheptulokinase (SHPK), mRNA.
ZBTB9—zinc finger and BTB domain containing 9 (ZBTB9), mRNA.
PC—pyruvate carboxylase (PC), nuclear gene encoding mitochondrial protein, transcript variant 1, mRNA.
USP19—Ubiquitin specific peptidase 19
RNPEPL1—arginyl aminopeptidase (aminopeptidase B)-like 1 (RNPEPL1), mRNA.
OR51I1—olfactory receptor, family 51, subfamily I, member 1 (OR51I1), mRNA.
WNK1—WNK lysine deficient protein kinase 1 (WNK1), transcript variant 3, mRNA.
APLP2—amyloid beta (A4) precursor-like protein 2 (APLP2), transcript variant 2, mRNA.
GIMAP6—GTPase, IMAP family member 6 (GIMAP6), transcript variant 1, mRNA.
VTI1B—vesicle transport through interaction with t-SNAREs homolog 1B (yeast) (VTI1B), mRNA.
STT3A—STT3, subunit of the oligosaccharyltransferase complex, homolog A (*S. cerevisiae*) (STT3A), mRNA.
DEK—DEK oncogene (DEK), transcript variant 2, mRNA.
CREG1—cellular repressor of E1A-stimulated genes 1 (CREG1), mRNA.
CCT8—chaperonin containing TCP1, subunit 8 (theta) (CCT8), mRNA.
PTDSS1—phosphatidylserine synthase 1 (PTDSS1), mRNA.
TEX261—testis expressed 261 (TEX261), mRNA.
NEIL2—nei endonuclease VIII-like 2 (*E. coli*) (NEIL2), transcript variant 2, mRNA.
C7orf26—chromosome 7 open reading frame 26 (C7orf26), mRNA.
TMEM176B—transmembrane protein 176B (TMEM176B), transcript variant 1, mRNA.
COL6A2—collagen, type VI, alpha 2 (COL6A2), transcript variant 2C2a', mRNA.
GRK6—G protein-coupled receptor kinase 6 (GRK6), transcript variant 1, mRNA.
OPN1MW2—opsin 1 (cone pigments), medium-wave-sensitive 2 (OPN1MW2), mRNA.
GBP5—guanylate binding protein 5 (GBP5), transcript variant 2, mRNA.
SAMHD1—SAM domain and HD domain 1 (SAMHD1), mRNA.
HLA-B—major histocompatibility complex, class I, B (HLA-B), mRNA.
GPR173—G protein-coupled receptor 173 (GPR173), mRNA.
APOLD1—apolipoprotein L domain containing 1 (APOLD1), transcript variant 2, mRNA.
FLJ46836—FLJ46836 protein
EIF5A—eukaryotic translation initiation factor 5A (EIF5A), transcript variant B, mRNA.
ZBTB17—zinc finger and BTB domain containing 17 (ZBTB17), mRNA.
UBE2L6—ubiquitin-conjugating enzyme E2L 6 (UBE2L6), transcript variant 1, mRNA.
SPHK2—sphingosine kinase 2 (SPHK2), mRNA.
AKR1A1—aldo-keto reductase family 1, member A1 (aldehyde reductase) (AKR1A1), transcript variant 2, mRNA.
LOC100287879—hypothetical LOC100287879 (LOC100287879), non-coding RNA.
LOC100288814—hypothetical protein LOC100288814 (LOC100288814), mRNA.
SMN1—survival of motor neuron 1, telomeric (SMN1), transcript variant b, mRNA.
OSR2—odd-skipped related 2 (*Drosophila*) (OSR2), transcript variant 1, mRNA.
PDZRN4—PDZ domain containing ring finger 4 (PDZRN4), transcript variant 2, mRNA.
C19orf60—Chromosome 19 open reading frame 60
PI15—peptidase inhibitor 15 (PI15), mRNA.
PCNXL2—pecanex-like 2 (*Drosophila*) (PCNXL2), transcript variant 1, mRNA.
ATP5S—ATP synthase, H+ transporting, mitochondrial Fo complex, subunit s (factor B) (ATP5S), nuclear gene encoding mitochondrial protein, transcript variant 3, mRNA.
LGTN—ligatin (LGTN), mRNA.
PAPD7—PAP associated domain containing 7 (PAPD7), transcript variant 2, mRNA.
GNS—glucosamine (N-acetyl)-6-sulfatase (GNS), mRNA.
CLTC—clathrin, heavy chain (Hc) (CLTC), mRNA.
MRPS18B—mitochondrial ribosomal protein S18B (MRPS18B), nuclear gene encoding mitochondrial protein, mRNA.
STRADB—STE20-related kinase adaptor beta (STRADB), mRNA.
AIMP2—aminoacyl tRNA synthetase complex-interacting multifunctional protein 2 (AIMP2), mRNA.
NAP1L4—nucleosome assembly protein 1-like 4 (NAP1L4), mRNA.
SSU72—SSU72 RNA polymerase II CTD phosphatase homolog (*S. cerevisiae*) (SSU72), mRNA.
CCDC107—coiled-coil domain containing 107 (CCDC107), transcript variant B, mRNA.
DYRK3—dual-specificity tyrosine-(Y)-phosphorylation regulated kinase 3 (DYRK3), transcript variant 2, mRNA.
ITPKA—inositol 1,4,5-trisphosphate 3-kinase A (ITPKA), mRNA.
FAM134A—family with sequence similarity 134, member A (FAM134A), mRNA.
EIF2AK4—eukaryotic translation initiation factor 2 alpha kinase 4 (EIF2AK4), mRNA.
MTIF2—mitochondrial translational initiation factor 2 (MTIF2), nuclear gene encoding mitochondrial protein, transcript variant 1, mRNA.
C7orf25—chromosome 7 open reading frame 25 (C7orf25), transcript variant 2, mRNA.
MRPS35—mitochondrial ribosomal protein S35 (MRPS35), nuclear gene encoding mitochondrial protein, transcript variant 1, mRNA.
TNPO3—transportin 3 (TNPO3), transcript variant 1, mRNA.

TABLE 67-continued

MEL-1936 Transcriptional Changes (STDEV exclusion/inclusion without filter)

CMAS—cytidine monophosphate N-acetylneuraminic acid synthetase (CMAS), mRNA.
SLC22A13—solute carrier family 22 (organic anion transporter), member 13 (SLC22A13), mRNA.
OSMR—oncostatin M receptor (OSMR), transcript variant 1, mRNA.
PSMG3—proteasome (prosome, macropain) assembly chaperone 3 (PSMG3), transcript variant 2, mRNA.
PARD3—par-3 partitioning defective 3 homolog (*C. elegans*) (PARD3), transcript variant 5, mRNA.
TXNDC5—thioredoxin domain containing 5 (endoplasmic reticulum) (TXNDC5), transcript variant 3, mRNA.
PPP1CB—protein phosphatase 1, catalytic subunit, beta isozyme (PPP1CB), transcript variant 1, mRNA.
RCN1—reticulocalbin 1, EF-hand calcium binding domain (RCN1), mRNA.
E2F5—E2F transcription factor 5, p130-binding (E2F5), transcript variant 3, mRNA.
TOMM22—translocase of outer mitochondrial membrane 22 homolog (yeast) (TOMM22), nuclear gene encoding mitochondrial protein, mRNA.
UBR7—ubiquitin protein ligase E3 component n-recognin 7 (putative) (UBR7), transcript variant 3, mRNA.
EZH2—enhancer of zeste homolog 2 (*Drosophila*) (EZH2), transcript variant 2, mRNA.
EIF5A—eukaryotic translation initiation factor 5A (EIF5A), transcript variant A, mRNA.
CHCHD2—coiled-coil-helix-coiled-coil-helix domain containing 2 (CHCHD2), mRNA.
MAPKAPK3—mitogen-activated protein kinase-activated protein kinase 3 (MAPKAPK3), mRNA.
SPHAR—S-phase response (cyclin related) (SPHAR), mRNA.
ARHGEF10L—Rho guanine nucleotide exchange factor (GEF) 10-like (ARHGEF10L), transcript variant 1, mRNA.
TMCC2—transmembrane and coiled-coil domain family 2 (TMCC2), mRNA.
PPP1R12B—protein phosphatase 1, regulatory (inhibitor) subunit 12B (PPP1R12B), transcript variant 4, mRNA.
LOC100130557—hypothetical LOC100130557 (LOC100130557), non-coding RNA.
CDCA4—cell division cycle associated 4 (CDCA4), transcript variant 1, mRNA.
C9orf125—chromosome 9 open reading frame 125 (C9orf125), mRNA.
SLC25A33—solute carrier family 25, member 33 (SLC25A33), mRNA.
UBE2M—ubiquitin-conjugating enzyme E2M (UBC12 homolog, yeast) (UBE2M), mRNA.
CCDC47—coiled-coil domain containing 47 (CCDC47), mRNA.
C5orf30—chromosome 5 open reading frame 30 (C5orf30), mRNA.

TABLE 68

MEL-888 Transcriptional Changes (STDEV inclusion/exclusion without filter)

SFRP5—secreted frizzled-related protein 5 (SFRP5), mRNA.
KIAA0087—KIAA0087 (KIAA0087), non-coding RNA.
TMEM181—transmembrane protein 181 (TMEM181), mRNA.
PAPL—iron/zinc purple acid phosphatase-like protein (PAPL), mRNA.
HMBOX1—Homeobox containing 1
PDGFD—platelet derived growth factor D (PDGFD), transcript variant 2, mRNA.
ALAS2—aminolevulinate, delta-, synthase 2 (ALAS2), nuclear gene encoding mitochondrial protein, transcript variant 3, mRNA.
CACNB3—calcium channel, voltage-dependent, beta 3 subunit (CACNB3), mRNA.
MRPS11—mitochondrial ribosomal protein S11 (MRPS11), nuclear gene encoding mitochondrial protein, transcript variant 2, mRNA.
SSRP1—structure specific recognition protein 1 (SSRP1), mRNA.
FAM86A—family with sequence similarity 86, member A (FAM86A), transcript variant 2, mRNA.
PDK3—pyruvate dehydrogenase kinase, isozyme 3 (PDK3), nuclear gene encoding mitochondrial protein, transcript variant 2, mRNA.
LMAN2—lectin, mannose-binding 2 (LMAN2), mRNA.
FBLN1—fibulin 1 (FBLN1), transcript variant C, mRNA.
CYTSA—cytospin A (CYTSA), transcript variant 2, mRNA.
CYBASC3—cytochrome b, ascorbate dependent 3 (CYBASC3), transcript variant 2, mRNA.
C21orf70—chromosome 21 open reading frame 70 (C21orf70), mRNA.
TIMM50—translocase of inner mitochondrial membrane 50 homolog (*S. cerevisiae*) (TIMM50), nuclear gene encoding mitochondrial protein, mRNA.
MYO9B—myosin IXB (MYO9B), transcript variant 1, mRNA.
RFNG—RFNG O-fucosylpeptide 3-beta-N-acetylglucosaminyltransferase (RFNG), mRNA.
DDX11—DEAD/H (Asp-Glu-Ala-Asp/His) box polypeptide 11 (DDX11), transcript variant 2, mRNA.
PTPRM—protein tyrosine phosphatase, receptor type, M (PTPRM), transcript variant 2, mRNA.
C20orf3—chromosome 20 open reading frame 3 (C20orf3), mRNA.
SREBF2—sterol regulatory element binding transcription factor 2 (SREBF2), mRNA.
SLC25A39—solute carrier family 25, member 39 (SLC25A39), transcript variant 2, mRNA.
TACO1—translational activator of mitochondrially encoded cytochrome c oxidase 1 (TACO1), nuclear gene encoding mitochondrial protein, mRNA.
SIGMAR1—sigma non-opioid intracellular receptor 1 (SIGMAR1), transcript variant 1, mRNA.
CERCAM—cerebral endothelial cell adhesion molecule (CERCAM), mRNA.
MYO1D—myosin ID (MYO1D), mRNA.
PKM2—pyruvate kinase, muscle (PKM2), transcript variant 2, mRNA.
CDK4—cyclin-dependent kinase 4 (CDK4), mRNA.
CMAS—cytidine monophosphate N-acetylneuraminic acid synthetase (CMAS), mRNA.
SRRD—SRR1 domain containing (SRRD), mRNA.

TABLE 68-continued

MEL-888 Transcriptional Changes (STDEV inclusion/exclusion without filter)

FAHD2B—fumarylacetoacetate hydrolase domain containing 2B (FAHD2B), mRNA.
SLC25A23—solute carrier family 25 (mitochondrial carrier; phosphate carrier), member 23 (SLC25A23), nuclear gene encoding mitochondrial protein, mRNA.
FKBP9—FK506 binding protein 9, 63 kDa (FKBP9), mRNA.
DAB2—disabled homolog 2, mitogen-responsive phosphoprotein (Drosophila) (DAB2), mRNA.
RAB38—RAB38, member RAS oncogene family (RAB38), mRNA.
C17orf58—chromosome 17 open reading frame 58 (C17orf58), transcript variant 2, mRNA.
PPPDE2—PPPDE peptidase domain containing 2 (PPPDE2), mRNA.
PHB2—prohibitin 2 (PHB2), transcript variant 2, mRNA.
TBRG4—transforming growth factor beta regulator 4 (TBRG4), transcript variant 3, mRNA.
AMZ2—archaelysin family metallopeptidase 2 (AMZ2), transcript variant 6, mRNA.
PSMG1—proteasome (prosome, macropain) assembly chaperone 1 (PSMG1), transcript variant 2, mRNA.
SAMM50—sorting and assembly machinery component 50 homolog (S. cerevisiae) (SAMM50), mRNA.
RGS10—regulator of G-protein signaling 10 (RGS10), transcript variant 2, mRNA.
SLC3A2—solute carrier family 3 (activators of dibasic and neutral amino acid transport), member 2 (SLC3A2), transcript variant 4, mRNA.
PLXNA2—plexin A2 (PLXNA2), mRNA.
PIGT—phosphatidylinositol glycan anchor biosynthesis, class T (PIGT), transcript variant 3, mRNA.
CDK2—cyclin-dependent kinase 2 (CDK2), transcript variant 2, mRNA.
TMEM203—transmembrane protein 203 (TMEM203), mRNA.
PHGDH—phosphoglycerate dehydrogenase (PHGDH), mRNA.
GUSB—glucuronidase, beta (GUSB), mRNA.
SIL1—SIL1 homolog, endoplasmic reticulum chaperone (S. cerevisiae) (SIL1), transcript variant 2, mRNA.
ATP6V1E1—ATPase, H+ transporting, lysosomal 31 kDa, V1 subunit E1 (ATP6V1E1), transcript variant 3, mRNA.
NCOR2—nuclear receptor corepressor 2 (NCOR2), transcript variant 1, mRNA.
LRPAP1—low density lipoprotein receptor-related protein associated protein 1 (LRPAP1), mRNA.
ATP5B—ATP synthase, H+ transporting, mitochondrial F1 complex, beta polypeptide (ATP5B), nuclear gene encoding mitochondrial protein, mRNA.
RAB32—RAB32, member RAS oncogene family (RAB32), mRNA.
IMMT—inner membrane protein, mitochondrial (IMMT), nuclear gene encoding mitochondrial protein, transcript variant 3, mRNA.
UCKL1—uridine-cytidine kinase 1-like 1 (UCKL1), transcript variant 1, mRNA.
FAM127C—family with sequence similarity 127, member C (FAM127C), mRNA.
HNRNPL—heterogeneous nuclear ribonucleoprotein L (HNRNPL), transcript variant 1, mRNA.
MRPS11—mitochondrial ribosomal protein S11 (MRPS11), nuclear gene encoding mitochondrial protein, transcript variant 1, mRNA.
SEPT5—septin 5 (SEPT5), mRNA.
POLD2—polymerase (DNA directed), delta 2, regulatory subunit 50 kDa (POLD2), transcript variant 2, mRNA.
C10orf35—chromosome 10 open reading frame 35 (C10orf35), mRNA.
VEGFB—vascular endothelial growth factor B (VEGFB), mRNA.
BLVRB—biliverdin reductase B (flavin reductase (NADPH)) (BLVRB), mRNA.
ANAPC11—anaphase promoting complex subunit 11 (ANAPC11), transcript variant 4, mRNA.
CREG1—cellular repressor of E1A-stimulated genes 1 (CREG1), mRNA.
SPCS1—signal peptidase complex subunit 1 homolog (S. cerevisiae) (SPCS1), mRNA.
PARP1—poly (ADP-ribose) polymerase 1 (PARP1), mRNA.
USP19—Ubiquitin specific peptidase 19
HLA-F—Major histocompatibility complex, class I, F
TRIOBP—TRIO and F-actin binding protein (TRIOBP), transcript variant 1, mRNA.
SLC22A18—solute carrier family 22, member 18 (SLC22A18), transcript variant 1, mRNA.
MARCKSL1—MARCKS-like 1 (MARCKSL1), mRNA.
TM9SF2—transmembrane 9 superfamily member 2 (TM9SF2), mRNA.
EID1—EP300 interacting inhibitor of differentiation 1 (EID1), mRNA.
NME4—non-metastatic cells 4, protein expressed in (NME4), nuclear gene encoding mitochondrial protein, mRNA.
CYC1—cytochrome c-1 (CYC1), nuclear gene encoding mitochondrial protein, mRNA.
TP53I13—tumor protein p53 inducible protein 13 (TP53I13), mRNA.
GNB1—guanine nucleotide binding protein (G protein), beta polypeptide 1 (GNB1), mRNA.
FAHD1—fumarylacetoacetate hydrolase domain containing 1 (FAHD1), nuclear gene encoding mitochondrial protein, transcript variant 2, mRNA.
NOC4L—nucleolar complex associated 4 homolog (S. cerevisiae) (NOC4L), mRNA.
NDUFV2—NADH dehydrogenase (ubiquinone) flavoprotein 2, 24 kDa (NDUFV2), nuclear gene encoding mitochondrial protein, mRNA.
COX5B—cytochrome c oxidase subunit Vb (COX5B), nuclear gene encoding mitochondrial protein, mRNA.
TMEM147—transmembrane protein 147 (TMEM147), mRNA.
NDUFB9—NADH dehydrogenase (ubiquinone) 1 beta subcomplex, 9, 22 kDa (NDUFB9), nuclear gene encoding mitochondrial protein, mRNA.
RPN2—ribophorin II (RPN2), transcript variant 1, mRNA.
MRPL41—mitochondrial ribosomal protein L41 (MRPL41), nuclear gene encoding mitochondrial protein, mRNA.
UQCRQ—ubiquinol-cytochrome c reductase, complex III subunit VII, 9.5 kDa (UQCRQ), nuclear gene encoding mitochondrial protein, mRNA.
GYPC—glycophorin C (Gerbich blood group) (GYPC), transcript variant 2, mRNA.
HMGN1—high-mobility group nucleosome binding domain 1 (HMGN1), mRNA.
SCO1—SCO cytochrome oxidase deficient homolog 1 (yeast) (SCO1), nuclear gene encoding mitochondrial protein, mRNA.
MGRN1—mahogunin, ring finger 1 (MGRN1), transcript variant 4, mRNA.
LOC402175—PREDICTED: similar to NADH dehydrogenase (ubiquinone) 1 beta subcomplex, 4, 15 kDa (LOC402175), miscRNA.
SNX10—sorting nexin 10 (SNX10), mRNA.
UROS—uroporphyrinogen III synthase (UROS), mRNA.

TABLE 68-continued

MEL-888 Transcriptional Changes (STDEV inclusion/exclusion without filter)

FAM195A—family with sequence similarity 195, member A (FAM195A), mRNA.
NDUFB11—NADH dehydrogenase (ubiquinone) 1 beta subcomplex, 11, 17.3 kDa (NDUFB11), nuclear gene encoding mitochondrial protein, transcript variant 2, mRNA.
UBE2D4—ubiquitin-conjugating enzyme E2D 4 (putative) (UBE2D4), mRNA.
NME2P1—non-metastatic cells 2, protein (NM23B) expressed in, pseudogene 1 (NME2P1), non-coding RNA.
MRPS15—mitochondrial ribosomal protein S15 (MRPS15), nuclear gene encoding mitochondrial protein, mRNA.
RNASEH1—ribonuclease H1 (RNASEH1), mRNA.
LSM4—LSM4 homolog, U6 small nuclear RNA associated (S. cerevisiae) (LSM4), mRNA.
PPIAL4G—peptidylprolyl isomerase A (cyclophilin A)-like 4G (PPIAL4G), mRNA.
AKR1B1—aldo-keto reductase family 1, member B1 (aldose reductase) (AKR1B1), mRNA.
PWP1—PWP1 homolog (S. cerevisiae) (PWP1), mRNA.
KDSR—3-ketodihydrosphingosine reductase (KDSR), mRNA.
RAB4A—RAB4A, member RAS oncogene family (RAB4A), mRNA.
STARD7—StAR-related lipid transfer (START) domain containing 7 (STARD7), mRNA.
SF3B2—splicing factor 3b, subunit 2, 145 kDa (SF3B2), mRNA.
C20orf11—chromosome 20 open reading frame 11 (C20orf11), mRNA.
ADSL—adenylosuccinate lyase (ADSL), transcript variant 1, mRNA.
UGCG—UDP-glucose ceramide glucosyltransferase (UGCG), mRNA.
PSMB4—proteasome (prosome, macropain) subunit, beta type, 4 (PSMB4), mRNA.
KDELR2—KDEL (Lys-Asp-Glu-Leu) endoplasmic reticulum protein retention receptor 2 (KDELR2), transcript variant 1, mRNA.
HDGF—hepatoma-derived growth factor (HDGF), transcript variant 1, mRNA.
MRPL55—mitochondrial ribosomal protein L55 (MRPL55), nuclear gene encoding mitochondrial protein, transcript variant 4, mRNA.
C7orf42—chromosome 7 open reading frame 42 (C7orf42), mRNA.
MRPL34—mitochondrial ribosomal protein L34 (MRPL34), nuclear gene encoding mitochondrial protein, mRNA.
TSPO—translocator protein (18 kDa) (TSPO), transcript variant PBR, mRNA.
LIPA—lipase A, lysosomal acid, cholesterol esterase (LIPA), transcript variant 2, mRNA.
CDC42EP3—CDC42 effector protein (Rho GTPase binding) 3 (CDC42EP3), mRNA.
CARS2—cysteinyl-tRNA synthetase 2, mitochondrial (putative) (CARS2), nuclear gene encoding mitochondrial protein, mRNA.
PSMD8—proteasome (prosome, macropain) 26S subunit, non-ATPase, 8 (PSMD8), mRNA.
SDCCAG3—serologically defined colon cancer antigen 3 (SDCCAG3), transcript variant 1, mRNA.
PSMG3—proteasome (prosome, macropain) assembly chaperone 3 (PSMG3), transcript variant 2, mRNA.
TMEM204—Transmembrane protein 204
RAB9A—RAB9A, member RAS oncogene family (RAB9A), transcript variant 2, mRNA.
BOLA3—bolA homolog 3 (E. coli) (BOLA3), transcript variant 2, mRNA.
RRAGA—Ras-related GTP binding A (RRAGA), mRNA.
HSD17B10—hydroxysteroid (17-beta) dehydrogenase 10 (HSD17B10), nuclear gene encoding mitochondrial protein, transcript variant 2, mRNA.
NQO1—NAD(P)H dehydrogenase, quinone 1 (NQO1), transcript variant 3, mRNA.
GSTP1—glutathione S-transferase pi 1 (GSTP1), mRNA.
TRAPPC5—trafficking protein particle complex 5 (TRAPPC5), transcript variant 3, mRNA.
CSTB—cystatin B (stefin B) (CSTB), mRNA.
FAM96B—family with sequence similarity 96, member B (FAM96B), transcript variant 1, mRNA.
STOM—stomatin (STOM), transcript variant 1, mRNA.
TAF10—TAF10 RNA polymerase II, TATA box binding protein (TBP)-associated factor, 30 kDa (TAF10), mRNA.
HIATL1—hippocampus abundant transcript-like 1 (HIATL1), mRNA.
PDCD6—programmed cell death 6 (PDCD6), mRNA.
ATP5F1—ATP synthase, H+ transporting, mitochondrial Fo complex, subunit B1 (ATP5F1), nuclear gene encoding mitochondrial protein, mRNA.
SH3GLB1—SH3-domain GRB2-like endophilin B1 (SH3GLB1), mRNA.
FAM50A—family with sequence similarity 50, member A (FAM50A), mRNA.
PPM1F—protein phosphatase, Mg2+/Mn2+ dependent, 1F (PPM1F), mRNA.
ADCK2—aarF domain containing kinase 2 (ADCK2), mRNA.
LARP1—La ribonucleoprotein domain family, member 1 (LARP1), transcript variant 1, mRNA.
CHKB—choline kinase beta (CHKB), mRNA.
CDC34—cell division cycle 34 homolog (S. cerevisiae) (CDC34), mRNA.
HNRNPU—heterogeneous nuclear ribonucleoprotein U (scaffold attachment factor A) (HNRNPU), transcript variant 2, mRNA.
NEIL2—nei endonuclease VIII-like 2 (E. coli) (NEIL2), transcript variant 2, mRNA.
UBE2Z—ubiquitin-conjugating enzyme E2Z (UBE2Z), mRNA.
EEA1—early endosome antigen 1 (EEA1), mRNA.
PCBP1—poly(rC) binding protein 1 (PCBP1), mRNA.
KHNYN—KH and NYN domain containing (KHNYN), mRNA.
POLR2E—polymerase (RNA) II (DNA directed) polypeptide E, 25 kDa (POLR2E), mRNA.
WDR18—WD repeat domain 18 (WDR18), mRNA.
CERK—ceramide kinase (CERK), mRNA.
RABAC1—Rab acceptor 1 (prenylated) (RABAC1), mRNA.
DULLARD—dullard homolog (Xenopus laevis) (DULLARD), transcript variant 2, mRNA.
CST3—cystatin C (CST3), mRNA.
DDB1—damage-specific DNA binding protein 1, 127 kDa (DDB1), mRNA.
FIBP—fibroblast growth factor (acidic) intracellular binding protein (FIBP), transcript variant 2, mRNA.
TRADD—TNFRSF1A-associated via death domain (TRADD), mRNA.
XPNPEP1—X-prolyl aminopeptidase (aminopeptidase P) 1, soluble (XPNPEP1), transcript variant 1, mRNA.
ADA—adenosine deaminase (ADA), mRNA.
PSMD9—proteasome (prosome, macropain) 26S subunit, non-ATPase, 9 (PSMD9), mRNA.
AURKAIP1—aurora kinase A interacting protein 1 (AURKAIP1), transcript variant 2, mRNA.

TABLE 68-continued

MEL-888 Transcriptional Changes (STDEV inclusion/exclusion without filter)

KEAP1—kelch-like ECH-associated protein 1 (KEAP1), transcript variant 2, mRNA.
ACAA1—acetyl-CoA acyltransferase 1 (ACAA1), transcript variant 2, mRNA.
RPRD1B—regulation of nuclear pre-mRNA domain containing 1B (RPRD1B), mRNA.
RAB5C—RAB5C, member RAS oncogene family (RAB5C), transcript variant 1, mRNA.
AFG3L2—AFG3 ATPase family gene 3-like 2 (*S. cerevisiae*) (AFG3L2), nuclear gene encoding mitochondrial protein, mRNA.
P4HB—prolyl 4-hydroxylase, beta polypeptide (P4HB), mRNA.
DKC1—dyskeratosis congenita 1, dyskerin (DKC1), transcript variant 2, mRNA.
RIC8A—resistance to inhibitors of cholinesterase 8 homolog A (C. elegans) (RIC8A), mRNA.
ACBD6—acyl-CoA binding domain containing 6 (ACBD6), mRNA.
PGM1—phosphoglucomutase 1 (PGM1), transcript variant 1, mRNA.
SCO2—SCO cytochrome oxidase deficient homolog 2 (yeast) (SCO2), nuclear gene encoding mitochondrial protein, transcript variant 2, mRNA.
NMU—neuromedin U (NMU), mRNA.
DENND1A—DENN/MADD domain containing 1A (DENND1A), transcript variant 2, mRNA.
NDUFAF3—NADH dehydrogenase (ubiquinone) 1 alpha subcomplex, assembly factor 3 (NDUFAF3), nuclear gene encoding mitochondrial protein, transcript variant 2, mRNA.
CSNK2B—casein kinase 2, beta polypeptide (CSNK2B), mRNA.
C18orf22—chromosome 18 open reading frame 22 (C18orf22), nuclear gene encoding mitochondrial protein, transcript variant 2, mRNA.
ATP5H—ATP synthase, H+ transporting, mitochondrial Fo complex, subunit d (ATP5H), nuclear gene encoding mitochondrial protein, transcript variant 1, mRNA.
RNPEP—arginyl aminopeptidase (aminopeptidase B) (RNPEP), mRNA.
BSG—basigin (Ok blood group) (BSG), transcript variant 2, mRNA.
DDT—D-dopachrome tautomerase (DDT), transcript variant 2, mRNA.
DDT—D-dopachrome tautomerase (DDT), transcript variant 2, mRNA.
LOC119358—PREDICTED: similar to hCG2040270 (LOC119358), mRNA.
BAMBI—BMP and activin membrane-bound inhibitor homolog (*Xenopus laevis*) (BAMBI), mRNA.
TBCB—tubulin folding cofactor B (TBCB), mRNA.
NDUFA8—NADH dehydrogenase (ubiquinone) 1 alpha subcomplex, 8, 19 kDa (NDUFA8), nuclear gene encoding mitochondrial protein, mRNA.
APEX1—APEX nuclease (multifunctional DNA repair enzyme) 1 (APEX1), transcript variant 2, mRNA.
ZNF706—zinc finger protein 706 (ZNF706), transcript variant 3, mRNA.
NDUFB2—NADH dehydrogenase (ubiquinone) 1 beta subcomplex, 2, 8 kDa (NDUFB2), nuclear gene encoding mitochondrial protein, mRNA.
CDK2AP1—cyclin-dependent kinase 2 associated protein 1 (CDK2AP1), mRNA.
NHP2L1—NHP2 non-histone chromosome protein 2-like 1 (*S. cerevisiae*) (NHP2L1), transcript variant 2, mRNA.
C16orf42—chromosome 16 open reading frame 42 (C16orf42), mRNA.
YWHAQ—tyrosine 3-monooxygenase/tryptophan 5-monooxygenase activation protein, theta polypeptide (YWHAQ), mRNA.
C1QBP—complement component 1, q subcomponent binding protein (C1QBP), nuclear gene encoding mitochondrial protein, mRNA.
PDIA6—protein disulfide isomerase family A, member 6 (PDIA6), mRNA.
CALM1—calmodulin 1 (phosphorylase kinase, delta) (CALM1), transcript variant 2, mRNA.
PSMD2—proteasome (prosome, macropain) 26S subunit, non-ATPase, 2 (PSMD2), mRNA.
NUP50—nucleoporin 50 kDa (NUP50), transcript variant 2, mRNA.
DAXX—death-domain associated protein (DAXX), transcript variant 3, mRNA.
HINT1—histidine triad nucleotide binding protein 1 (HINT1); transcript variant 1, mRNA.
SPG21—spastic paraplegia 21 (autosomal recessive, Mast syndrome) (SPG21), transcript variant 1, mRNA.
VTI1B—vesicle transport through interaction with t-SNAREs homolog 1B (yeast) (VTI1B), mRNA.
ARL2BP—ADP-ribosylation factor-like 2 binding protein (ARL2BP), mRNA.
MC1R—melanocortin 1 receptor (alpha melanocyte stimulating hormone receptor) (MC1R), mRNA.
SPARC—secreted protein, acidic, cysteine-rich (osteonectin) (SPARC), mRNA.
PFN1—profilin 1 (PFN1), mRNA.
NME2—non-metastatic cells 2, protein (NM23B) expressed in (NME2), transcript variant 3, mRNA.
C20orf24—chromosome 20 open reading frame 24 (C20ort24), transcript variant 1, mRNA.
COX8A—cytochrome c oxidase subunit VIIIA (ubiquitous) (COX8A), mRNA.
TSPO—translocator protein (18 kDa) (TSPO), transcript variant PBR, mRNA.
PTP4A2—protein tyrosine phosphatase type IVA, member 2 (PTP4A2), transcript variant 3, mRNA.
SSR4—signal sequence receptor, delta (translocon-associated protein delta) (SSR4), mRNA.
ARPC1B—actin related protein 2/3 complex, subunit 1B, 41 kDa (ARPC1B), mRNA.
USP14—ubiquitin specific peptidase 14 (tRNA-guanine transglycosylase) (USP14), transcript variant 2, mRNA.
FBXO9—F-box protein 9 (FBXO9), transcript variant 3, mRNA.
GTF3A—general transcription factor IIIA (GTF3A), mRNA.
MRPS24—mitochondrial ribosomal protein S24 (MRPS24), nuclear gene encoding mitochondrial protein, mRNA.
EIF3J—eukaryotic translation initiation factor 3, subunit J (EIF3J), mRNA.
BAG1—BCL2-associated athanogene (BAG1), transcript variant 1, mRNA.
IFI6—interferon, alpha-inducible protein 6 (IFI6), transcript variant 1, mRNA.
HSD17B12—hydroxysteroid (17-beta) dehydrogenase 12 (HSD17B12), mRNA.
PSMD2—proteasome (prosome, macropain) 26S subunit, non-ATPase, 2 (PSMD2), mRNA.
SLBP—stem-loop binding protein (SLBP), mRNA.
STK24—serine/threonine kinase 24 (STK24), transcript variant 1, mRNA.
GUSB—glucuronidase, beta (GUSB), mRNA.
DUS3L—dihydrouridine synthase 3-like (*S. cerevisiae*) (DUS3L), transcript variant 2, mRNA.
MAN1B1—mannosidase, alpha, class 1B, member 1 (MAN1B1), mRNA.
PIGY—phosphatidylinositol glycan anchor biosynthesis, class Y (PIGY), nuclear gene encoding mitochondrial protein, transcript variant 1, mRNA.
DCTD—dCMP deaminase (DCTD), transcript variant 2, mRNA.

TABLE 68-continued

MEL-888 Transcriptional Changes (STDEV inclusion/exclusion without filter)

SSU72—SSU72 RNA polymerase II CTD phosphatase homolog (*S. cerevisiae*) (SSU72), mRNA.
GLUD1—glutamate dehydrogenase 1 (GLUD1), nuclear gene encoding mitochondrial protein, mRNA.
NOMO1—NODAL modulator 1 (NOMO1), mRNA.
C7orf47—chromosome 7 open reading frame 47 (C7orf47), mRNA.
YME1L1—YME1-like 1 (*S. cerevisiae*) (YME1L1), nuclear gene encoding mitochondrial protein, transcript variant 3, mRNA.
RBX1—ring-box 1 (RBX1), mRNA.
CCDC72—coiled-coil domain containing 72 (CCDC72), mRNA.
SEC11C—SEC11 homolog C (*S. cerevisiae*) (SEC11C), mRNA.
EIF1AX—eukaryotic translation initiation factor 1A, X-linked (EIF1AX), mRNA.
ANKRD62—Ankyrin repeat domain 62
YBX1—Y box binding protein 1
RCN1—reticulocalbin 1, EF-hand calcium binding domain (RCN1), mRNA.
NBN—nibrin (NBN), mRNA.
CTSL1—cathepsin L1 (CTSL1), transcript variant 1, mRNA.
ALG3—asparagine-linked glycosylation 3, alpha-1,3-mannosyltransferase homolog (*S. cerevisiae*) (ALG3), transcript variant 1, mRNA.
UPP1—uridine phosphorylase 1 (UPP1), transcript variant 1, mRNA.
UPP1—uridine phosphorylase 1 (UPP1), transcript variant 1, mRNA.
RPN2—ribophorin II (RPN2), transcript variant 1, mRNA.
FTHL3—ferritin, heavy polypeptide-like 3 (FTHL3), non-coding RNA.
SPR—sepiapterin reductase (7,8-dihydrobiopterin:NADP+ oxidoreductase) (SPR), mRNA.
NDUFS3—NADH dehydrogenase (ubiquinone) Fe—S protein 3, 30 kDa (NADH-coenzyme Q reductase) (NDUFS3), nuclear gene encoding mitochondrial protein, mRNA.
C1orf57—chromosome 1 open reading frame 57 (C1orf57), mRNA.
CHCHD10—coiled-coil-helix-coiled-coil-helix domain containing 10 (CHCHD10), mRNA.
DUSP4—dual specificity phosphatase 4 (DUSP4), transcript variant 2, mRNA.
CCDC92—coiled-coil domain containing 92 (CCDC92), mRNA.
ATP5H—ATP synthase, H+ transporting, mitochondrial Fo complex, subunit d (ATP5H), nuclear gene encoding mitochondrial protein, transcript variant 2, mRNA.
ALKBH7—alkB, alkylation repair homolog 7 (*E. coli*) (ALKBH7), mRNA.
TMED4—transmembrane emp24 protein transport domain containing 4 (TMED4), mRNA.
DNAJC1—DnaJ (Hsp40) homolog, subfamily C, member 1 (DNAJC1), mRNA.
CIB1—calcium and integrin binding 1 (calmyrin) (CIB1), mRNA.
KLF14—Kruppel-like factor 14 (KLF14), mRNA.
PDXK—pyridoxal (pyridoxine, vitamin B6) kinase (PDXK), mRNA.
CCDC107—coiled-coil domain containing 107 (CCDC107), transcript variant B, mRNA.
COMTD1—catechol-O-methyltransferase domain containing 1 (COMTD1), mRNA.
CD99—CD99 molecule (CD99), transcript variant 1, mRNA.
LRRFIP2—leucine rich repeat (in FLII) interacting protein 2 (LRRFIP2), transcript variant 1, mRNA.
TMEM49—transmembrane protein 49 (TMEM49), mRNA.
UQCRC1—ubiquinol-cytochrome c reductase core protein I (UQCRC1), mRNA.
SYTL2—synaptotagmin-like 2 (SYTL2), transcript variant b, mRNA.
SGSH—N-sulfoglucosamine sulfohydrolase (SGSH), mRNA.
FAM134A—family with sequence similarity 134, member A (FAM134A), mRNA.
TIMP2—TIMP metallopeptidase inhibitor 2 (TIMP2), mRNA.
PTDSS2—phosphatidylserine synthase 2 (PTDSS2), mRNA.
DGAT1—diacylglycerol O-acyltransferase 1 (DGAT1), mRNA.
SNX1—sorting nexin 1 (SNX1), transcript variant 1, mRNA.
GNAS—GNAS complex locus (GNAS), transcript variant 7, mRNA.
C1orf151—chromosome 1 open reading frame 151 (C1orf151), transcript variant 1, mRNA.
ATP5I—ATP synthase, H+ transporting, mitochondrial Fo complex, subunit E (ATP5I), nuclear gene encoding mitochondrial protein, transcript variant 1, mRNA.
ARL6IP4—ADP-ribosylation-like factor 6 interacting protein 4 (ARL6IP4), transcript variant 1, mRNA.
STARD3NL—STARD3 N-terminal like (STARD3NL), mRNA.
ITGB1BP1—integrin beta 1 binding protein 1 (ITGB1BP1), transcript variant 1, mRNA.
YBX1—Y box binding protein 1 (YBX1), mRNA.
--Transcribed locus, strongly similar to NP_113751.3 nuclease-sensitive element-binding protein 1 [*Rattus norvegicus*]
FUCA1—fucosidase, alpha-L-1, tissue (FUCA1), mRNA.
SNX17—sorting nexin 17 (SNX17), mRNA.
CTSB—cathepsin B (CTSB), transcript variant 5, mRNA.
AK2—adenylate kinase 2 (AK2), transcript variant AK2A, mRNA.
CSTB—cystatin B (stefin B) (CSTB), mRNA.
KIFC3—kinesin family member C3 (KIFC3), transcript variant 3, mRNA.
ARFGAP1—ADP-ribosylation factor GTPase activating protein 1 (ARFGAP1), transcript variant 1, mRNA.
FAM20B—family with sequence similarity 20, member B (FAM20B), mRNA.
NAP1L4—nucleosome assembly protein 1-like 4 (NAP1L4), mRNA.
STT3A—STT3, subunit of the oligosaccharyltransferase complex, homolog A (*S. cerevisiae*) (STT3A), mRNA.
RRP36—ribosomal RNA processing 36 homolog (*S. cerevisiae*) (RRP36), mRNA.
S100A11—S100 calcium binding protein A11 (S100A11), mRNA.
SREBF1—sterol regulatory element binding transcription factor 1 (SREBF1), transcript variant 1, mRNA.
GMPR—guanosine monophosphate reductase (GMPR), mRNA.
MRP63—mitochondrial ribosomal protein 63 (MRP63), nuclear gene encoding mitochondrial protein, mRNA.
PSMD8—proteasome (prosome, macropain) 26S subunit, non-ATPase, 8 (PSMD8), mRNA.
PSEN2—presenilin 2 (Alzheimer disease 4) (PSEN2), transcript variant 2, mRNA.
LAPTM4B—lysosomal protein transmembrane 4 beta (LAPTM4B), mRNA.
BLVRA—biliverdin reductase A (BLVRA), mRNA.
AKT2—v-akt murine thymoma viral oncogene homolog 2 (AKT2), mRNA.

TABLE 68-continued

MEL-888 Transcriptional Changes (STDEV inclusion/exclusion without filter)

LOC152217—hypothetical LOC152217 (LOC152217), non-coding RNA.
GLCCI1—glucocorticoid induced transcript 1 (GLCCI1), mRNA.
SLC35B1—solute carrier family 35, member B1 (SLC35B1), mRNA.
EMP1—epithelial membrane protein 1 (EMP1), mRNA.
TNFRSF17—tumor necrosis factor receptor superfamily, member 17 (TNFRSF17), mRNA.
RBPMS—RNA binding protein with multiple splicing (RBPMS), transcript variant 3, mRNA.
LOC80154—hypothetical LOC80154 (LOC80154), non-coding RNA.
LGMN—legumain (LGMN), transcript variant 1, mRNA.
POLDIP2—polymerase (DNA-directed), delta interacting protein 2 (POLDIP2), mRNA.
TSPAN5—tetraspanin 5 (TSPAN5), mRNA.
NFKBIA—nuclear factor of kappa light polypeptide gene enhancer in B-cells inhibitor, alpha (NFKBIA), mRNA.
PTPN3—protein tyrosine phosphatase, non-receptor type 3 (PTPN3), transcript variant 5, mRNA.
ZNF259—zinc finger protein 259 (ZNF259), mRNA.
ITM2A—integral membrane protein 2A (ITM2A), transcript variant 1, mRNA.
CHPT1—choline phosphotransferase 1 (CHPT1), mRNA.
AGPS—alkylglycerone phosphate synthase (AGPS), mRNA.
XKR9—XK-related protein 9. [Source: Uniprot/SWISSPROT; Acc: Q5GH70]
CCDC47—coiled-coil domain containing 47 (CCDC47), mRNA.
INPP4A—inositol polyphosphate-4-phosphatase, type I, 107 kDa (INPP4A), transcript variant c, mRNA.
WBP5—WW domain binding protein 5 (WBP5), transcript variant 4, mRNA.
TMPRSS9—transmembrane protease, serine 9 (TMPRSS9), mRNA.
CLSTN1—calsyntenin 1 (CLSTN1), transcript variant 2, mRNA.
HYI—hydroxypyruvate isomerase (putative) (HYI), transcript variant 1, mRNA.
FGF13—fibroblast growth factor 13 (FGF13), transcript variant 2, mRNA.
SLC35B4—solute carrier family 35, member B4 (SLC35B4), mRNA.
AOAH—acyloxyacyl hydrolase (neutrophil) (AOAH), transcript variant 2, mRNA.
CREB5—cAMP responsive element binding protein 5 (CREB5), transcript variant 3, mRNA.
EMR3—Egf-like module containing, mucin-like, hormone receptor-like 3
SPRYD4—SPRY domain containing 4 (SPRYD4), mRNA.
KCNS1—potassium voltage-gated channel, delayed-rectifier, subfamily S. member 1 (KCNS1), mRNA.
C15orf21—chromosome 15 open reading frame 21 (C15orf21), non-coding RNA.
NPHS2—nephrosis 2, idiopathic, steroid-resistant (podocin) (NPHS2), mRNA.
MAPK12—mitogen-activated protein kinase 12 (MAPK12), mRNA.
NAPSB—napsin B aspartic peptidase pseudogene (NAPSB), non-coding RNA.
PMS2L2—postmeiotic segregation increased 2-like 2 pseudogene (PMS2L2), non-coding RNA.
METRNL—meteorin, glial cell differentiation regulator-like (METRNL), mRNA.
DNAJB1—DnaJ (Hsp40) homolog, subfamily B, member 1 (DNAJB1), mRNA.
PRKD2—protein kinase D2 (PRKD2), transcript variant 2, mRNA.
C21orf89—PREDICTED: chromosome 21 open reading frame 89 (C21orf89), miscRNA.
LOC100289224—PREDICTED: hypothetical protein LOC100289224 (LOC100289224), mRNA.
C8orf51—chromosome 8 open reading frame 51 (C8orf51), non-coding RNA.
BAI2—brain-specific angiogenesis inhibitor 2 (BAI2), mRNA.
HORMAD1—HORMA domain containing 1 (HORMAD1), mRNA.
KRT19—keratin 19 (KRT19), mRNA.
C19orf26—chromosome 19 open reading frame 26 (C19orf26), mRNA.
ZNF638—zinc finger protein 638 (ZNF638), transcript variant 2, mRNA.
HUS1B—HUS1 checkpoint homolog b (*S. pombe*) (HUS1B), mRNA.
KIAA1244—KIAA1244 (KIAA1244), mRNA.
ARHGAP39—Rho GTPase activating protein 39 (ARHGAP39), mRNA.
SRCIN1—SRC kinase signaling inhibitor 1 (SRCIN1), mRNA.
C15orf51—chromosome 15 open reading frame 51 (C15orf51), non-coding RNA.
SEPT7P2—Septin 7 pseudogene 2
DUSP8—dual specificity phosphatase 8 (DUSP8), mRNA.
MGC23270—hypothetical LOC196872 (MGC23270), non-coding RNA.
KLHL38—kelch-like 38 (*Drosophila*) (KLHL38), mRNA.
CHN2—chimerin (chimaerin) 2 (CHN2), transcript variant 2, mRNA.
UPK3A—uroplakin 3A (UPK3A), transcript variant 2, mRNA.
C1orf91—Chromosome 1 open reading frame 91
LOC729213—PREDICTED: similar to ectonucleotide pyrophosphatase/phosphodiesterase 5 (putative function) (LOC729213), mRNA.
AHCY—adenosylhomocysteinase (AHCY), transcript variant 1, mRNA.
ZNF483—Zinc finger protein 483
LDLRAD2—low density lipoprotein receptor class A domain containing 2 (LDLRAD2), mRNA.
MBD3L5—methyl-CpG-binding domain protein 3-like 5-like (MBD3L5), mRNA.
ZNF705D—zinc finger protein 705D (ZNF705D), mRNA.
HIATL2—hippocampus abundant transcript-like 2 (HIATL2), non-coding RNA.
RAB11FIP1—Rab11 family-interacting protein 1 (Rab11-FIP1) (Rab-coupling protein). [Source: Uniprot/SWISSPROT: Acc: Q6WKZ4]
DEM1—defects in morphology 1 homolog (*S. cerevisiae*) (DEM1), mRNA.
BCDIN3D—BCDIN3 domain containing (BCDIN3D), mRNA.
MICAL3—microtubule associated monoxygenase, calponin and LIM domain containing 3 (MICAL3), transcript variant 2, mRNA.
ZNF354B—Zinc finger protein 354B
P2RX2—purinergic receptor P2X, ligand-gated ion channel, 2 (P2RX2), transcript variant 6, mRNA.
RUNDC2C—RUN domain containing 2C
ANKRD25—ankyrin repeat domain 25 [Source: RefSeq_peptide: Acc: NP_056308]
AURKA—aurora kinase A (AURKA), transcript variant 1, mRNA.
OR1J1—olfactory receptor, family 1, subfamily J, member 1 (OR1J1), mRNA.

TABLE 68-continued

MEL-888 Transcriptional Changes (STDEV inclusion/exclusion without filter)

ZNF69—zinc finger protein 69 (ZNF69), mRNA.
RIMS2—Regulating synaptic membrane exocytosis protein 2 (Rab3-interacting molecule 2) (RIM 2).
[Source: Uniprot/SWISSPROT; Acc: Q9UQ26]
ZNF93—Zinc finger protein 93
AP1S3—adaptor-related protein complex 1, sigma 3 subunit (AP1S3), mRNA.
TRPM6—Transient receptor potential cation channel, subfamily M, member 6
PARP14—Poly (ADP-ribose) polymerase family, member 14
RASA4—RAS p21 protein activator 4 (RASA4), transcript variant 1, mRNA.
ATAD3A—ATPase family, AAA domain containing 3A
FKBP14—FK506 binding protein 14, 22 kDa (FKBP14), mRNA.
RSPH3—Radial spoke 3 homolog (Chlamydomonas)
FGR—Gardner-Rasheed feline sarcoma viral (v-fgr) oncogene homolog (FGR), transcript variant 3, mRNA.
HIST2H3D—histone cluster 2, H3d (HIST2H3D), mRNA.
ZBTB43—zinc finger and BTB domain containing 43 (ZBTB43), transcript variant 2, mRNA.
ZNF91—zinc finger protein 91 (ZNF91), mRNA.
HSPA8—Heat shock 70 kDa protein 8
LYPD3—LY6/PLAUR domain containing 3 (LYPD3), mRNA.
ALG10—asparagine-linked glycosylation 10, alpha-1,2-glucosyltransferase homolog (S. pombe) (ALG10), mRNA.
VARV-gp134—Variola virus gp134 protein
ZNF532—Zinc finger protein 532
TRIM15—tripartite motif-containing 15 (TRIM15), mRNA.
GADD45B—growth arrest and DNA-damage-inducible, beta (GADD45B), mRNA.
C1orf147—PREDICTED: chromosome 1 open reading frame 147 (C1orf147), miscRNA.
FLJ46838—PREDICTED: FLJ46838 protein (FLJ46838), miscRNA.
DKFZp564H213—Hypothetical LOC440432
LY6H—lymphocyte antigen 6 complex, locus H (LY6H), transcript variant 1, mRNA.
MRPL39—mitochondrial ribosomal protein L39 (MRPL39), nuclear gene encoding mitochondrial protein, transcript variant 2, mRNA.
LOC100131551—Hypothetical LOC100131551
CCT6P1—chaperonin containing TCP1, subunit 6 (zeta) pseudogene 1 (CCT6P1), non-coding RNA.
CACNA1G—Calcium channel, voltage-dependent, T type, alpha 1G subunit
ABCD3—ATP-binding cassette, sub-family D (ALD), member 3 (ABCD3), transcript variant 2, mRNA.
GALNTL2—UDP-N-acetyl-alpha-D-galactosamine:polypeptide N-acetylgalactosaminyltransferase-like 2 (GALNTL2), mRNA.
LOC390414—PREDICTED: hypothetical LOC390414 (LOC390414), miscRNA.
SRGAP2—SLIT-ROBO Rho GTPase activating protein 2 (SRGAP2), transcript variant 3, mRNA.
C20orf107—chromosome 20 open reading frame 107 (C20orf107), mRNA.
ZBTB32—zinc finger and BTB domain containing 32 (ZBTB32), mRNA.
C7orf68—Chromosome 7 open reading frame 68
ZNF492—zinc finger protein 492 (ZNF492), mRNA.
BCYRN1—brain cytoplasmic RNA 1 (non-protein coding) (BCYRN1), non-coding RNA.
C14orf126—chromosome 14 open reading frame 126 (C14orf126), mRNA.
JMJD6—jumonji domain containing 6 (JMJD6), transcript variant 1, mRNA.
ZMYM2—zinc finger, MYM-type 2 (ZMYM2), transcript variant 1, mRNA.
TNKS1BP1—Tankyrase 1 binding protein 1, 182 kDa
SPEN—spen homolog, transcriptional regulator (Drosophila) (SPEN), mRNA.
RBPJ—Recombination signal binding protein for immunoglobulin kappa J region
MRGPRE—MAS-related GPR, member E (MRGPRE), mRNA.
XP_292723.3—PREDICTED: similar to zinc finger and SCAN domain containing 5
[Source: RefSeq_peptide_predicted; Acc: XP_943301]
CEBPE—CCAAT/enhancer binding protein (C/EBP), epsilon (CEBPE), mRNA.
TPTE2P2—transmembrane phosphoinositide 3-phosphatase and tensin homolog 2 pseudogene 2 (TPTE2P2), non-coding RNA.
FBXO4—F-box protein 4 (FBXO4), transcript variant 1, mRNA.
ZNF620—zinc finger protein 620 (ZNF620), transcript variant 1, mRNA.
NANS—N-acetylneuraminic acid synthase (NANS), mRNA.
DCTN5—dynactin 5 (p25) (DCTN5), mRNA.
ZNF79—zinc finger protein 79 (ZNF79), mRNA.
TERF1—telomeric repeat binding factor (NIMA-interacting) 1 (TERF1), transcript variant 2, mRNA.
NCRNA00268—Non-protein coding RNA 268
UBA52—ubiquitin A-52 residue ribosomal protein fusion product 1 (UBA52), transcript variant 2, mRNA.
PDE4B—phosphodiesterase 4B, cAMP-specific (PDE4B), transcript variant a, mRNA.
DOCK2—dedicator of cytokinesis 2 (DOCK2), mRNA.
LOC100128164—four and a half LIM domains 1 pseudogene (LOC100128164), transcript variant 2, non-coding RNA.
FLJ46134—Hypothetical LOC400799
LOC388948—hypothetical LOC388948 (LOC388948), non-coding RNA.
TAPBP—TAP binding protein (tapasin) (TAPBP), transcript variant 3, mRNA.
NPPB—natriuretic peptide precursor B (NPPB), mRNA.
MFN1—mitofusin 1 (MFN1), nuclear gene encoding mitochondrial protein, mRNA.
SPHK2—sphingosine kinase 2 (SPHK2), mRNA.
LOC100288570—PREDICTED: similar to glycosylphosphatidylinositol anchor attachment protein 1 homolog (yeast) (LOC100288570), mRNA.
RN5S1—RNA, 5S ribosomal 1 (RN5S1), ribosomal RNA.
OSCAR—Osteoclast associated, immunoglobulin-like receptor
RGS1—regulator of G-protein signaling 1 (RGS1), mRNA.
HSD3B7—hydroxy-delta-5-steroid dehydrogenase, 3 beta- and steroid delta-isomerase 7 (HSD3B7), transcript variant 1, mRNA.
CGN—cingulin (CGN), mRNA.

TABLE 68-continued

MEL-888 Transcriptional Changes (STDEV inclusion/exclusion without filter)

ADAMTS9—ADAM metallopeptidase with thrombospondin type 1 motif, 9 (ADAMTS9), mRNA.
NDUFA9—NADH dehydrogenase (ubiquinone) 1 alpha subcomplex, 9, 39 kDa (NDUFA9), nuclear gene encoding mitochondrial protein, mRNA.
DCAKD—dephospho-CoA kinase domain containing (DCAKD), transcript variant 1, mRNA.
UBQLNL—ubiquilin-like (UBQLNL), mRNA.
YIF1A—Yip1 interacting factor homolog A (S. cerevisiae) (YIF1A), mRNA.
NAA16—N(alpha)-acetyltransferase 16, NatA auxiliary subunit (NAA16), transcript variant 3, mRNA.
LOC645212—hypothetical LOC645212 (LOC645212), transcript variant 1, non-coding RNA.
CYBB—cytochrome b-245, beta polypeptide (CYBB), mRNA.
SLIT3—slit homolog 3 (Drosophila) (SLIT3), mRNA.
C7orf69—chromosome 7 open reading frame 69 (C7orf69), mRNA.
PSG3—pregnancy specific beta-1-glycoprotein 3 (PSG3), mRNA.

b. Vaccinia Virus Gene Transcriptional Changes

Three array clusters were analyzed (control, 2 hpi; early genes and 10 hpi; late genes). In addition, 4 main gene clusters also were analyzed (C1, C2, C3a/3b and C4). The array clusters showed that time point and infection influence gene expression pattern the most, as shown based on segregation between controls, 2 hpi, and 10 hpi. Gene clusters showed specific patterns, thereby reflecting different temporal expression classes and functional categories such as: VACV entry and spread, VACV structure and assembly, VACV DNA replication and RNA transcription, host interactions and immune modulations, and other/unknown functions. The results showed that there was a similar low expression at 2 and 10 hours hpi of early/late genes and that the genes were interspersed throughout all categories. There was increased expression at 10 hpi of late genes with genes enriched in structure and assembly class. There was a decreased expression at 10 hpi of early and early/late genes enriched in DNA replication/RNA transcription class. There also was a similar high expression at 2 and 10 hpi of early and early/late genes that were enriched in DNA replication/RNA transcription and host interactions/immune modulators. Thus, the results showed that the vaccinia virus gene transcriptional changes over time after infection related to genes involved in vaccinia virus entry and spread, structure and assembly, DNA replication/RNA transcription, host interaction/immune modulation. Other genes of unknown function also were associated with transcriptional changes.

c. Replication Efficiency

Replication efficiency was determined from growth curves of viral titers obtained at timepoints from 0 to 10 hpi. Titers were in plaque forming units per $10^6$ cells. For all viruses tested, the replication efficiency initially decreased 2 hpi, but then steadily increased in a time-dependent manner at 10 hpi. GLV-1h68 displayed the lowest replication efficiency. LIVP 1.1.1, LIVP 5.1.1 and LIVP 6.1.1. displayed similar replication efficiency, although LIVP 6.1.1. showed the highest titers. LIVP 5.1.1 and LIVP 1.1.1. exhibited comparable replication efficiencies.

The replication efficiency was compared to vaccinia-gene transcription levels. Seven (7) vaccinia early genes (V149, V194, V189, V104, V069, V167, and V106) were used for correlation analysis by hierarchical clustering of expression levels. The hierarchy of levels of gene expression in a set of 7 viral early genes matched with the respective replication efficiency at 2 hpi (see Tables 69 and 70, which set forth the expression levels of the genes at 2hpi). Similar to the replication efficiency results, GLV-1h68 exhibited the lowest mean gene transcription levels, whereas LIVP 6.1.1 showed the highest expression values. LIVP 1.1.1 and LIVP 5.1.1 exhibited comparable transcriptional levels at 2 hpi. These data indicate a correlation between vaccinia early gene transcription and vaccinia early genome replication.

TABLE 69

Correlation of vaccinia early gene expression to replication efficiency (888-MEL)

| Gene | 1h68 | L511 | L111 | L611 |
|---|---|---|---|---|
| VACGL069__unknown | 7.38001 | 7.52207 | 7.55892 | 7.65163 |
| VACGL104__late transcription elongation factor | 6.95362 | 7.42775 | 7.5386 | 7.99347 |
| VACGL106__viral membrane formation protein | 7.25516 | 7.78636 | 7.9264 | 8.49585 |
| VACGL149__contains mutT-like motif of NTP-phosphohydrolase for DNA repair | 6.84707 | 7.0116 | 7.09935 | 7.25484 |
| VACGL167__DNA-dependent RNA polymerase subunit rpo19 | 7.51383 | 7.68261 | 7.91613 | 8.14413 |
| VACGL189__viral DNA polymerase processivity factor | 6.64873 | 7.42331 | 7.39033 | 7.98892 |
| VACGL194__DNA-dependent RNA polymerase subunit rpo132 | 6.89847 | 7.25057 | 7.22874 | 7.4784 |

TABLE 70

Correlation of vaccinia early gene expression to replication efficiency (1936-MEL)

| Gene | 1h68 | L511 | L111 | L611 |
|---|---|---|---|---|
| VACGL069__unknown | 7.20523 | 7.54097 | 7.55534 | 7.64865 |
| VACGL104__late transcription elongation factor | 7.18112 | 7.83809 | 7.853 | 8.195 |
| VACGL106__viral membrane formation protein | 8.11503 | 8.75754 | 8.96633 | 9.07872 |
| VACGL149__contains mutT-like motif of NTP-phosphohydrolase for DNA repair | 7.1184 | 7.19542 | 7.53341 | 7.68812 |
| VACGL167__DNA-dependent RNA polymerase subunit rpo19 | 7.96658 | 8.03929 | 8.18193 | 8.185 |
| VACGL189__viral DNA polymerase processivity factor | 7.12139 | 7.82778 | 7.96655 | 8.00612 |
| VACGL194__DNA-dependent RNA polymerase subunit rpo132 | 6.91024 | 7.28462 | 7.46623 | 7.62953 |

In addition, the replication efficiency also was compared to human-gene transcription levels. The results showed that 114 human genes exhibited strong correlations ($R^2 \geq 0.6$) with the averaged vaccinia early gene transcription. These genes were organized in the following networks: post-translational modification, gene expression, cell death and cellular growth and proliferation. The top molecular functions were cell cycle, cellular movement, growth and proliferation and cell-to-cell signaling. Viral candidate genes identified by their transcriptional behavior, which are characteristic for viral replication, were used to see if there are human genes that could influence these viral genes and thus replication efficiency. The human genes with the strongest positive correlates with viral transcription as determined from correlation analysis by hierarchial clustering of expression levels (Pearson correlation, $R^2=0.8$) were MLL5, LRRFIP2, CSRNP2, EFHD1, TXNRD3, ARFIP2, ENTPD6, ITPKA, YTHDF2, MRSPS11 and PREP. The correlation analyses between host gene expression and the viral candidate genes revealed a strong negative or positive correlation with a set of human genes.

3. Summary

The results indicate a direct correlation between viral replication, early gene expression and the respective host response.

Example 14

Generation of a Canine Soft Tissue Sarcomas (CSTS) Cell Line Designated STSA-1

The cell line STSA-1 was derived from a tumor of a seven-year old, male, neutered, golden retriever dog that presented with a firm painful, erythematous mass on the left forelimb. The mass was surgically debulked with excision of the deep digital flexor and flexor carpi muscles as they were extensively infiltrated by the tumor. The subject underwent full course radiation therapy. At a three month recheck examination, thoracic radiographs and abdominal ultrasound showed no evidence of metastasis, but radiographs of the left front limb revealed severe lysis of the distal una, caudal distal radiu, and carpal bones. A fine needle aspirate of an enlarged left prescapular lymph node was diagnosed by cytology as metastatic meschencymal neoplasia. At this time, the limb was amputated and enlarged lymph nodes were removed. Histology on formalin-fixed samples of the limb and axiallary and prescapular lymph nodes confirmed that the lesion was consistent with soft tissue sarcoma of intermediate grade with vascular invasion, infiltration of tumor cells into the bone marrow cavity and metastases to draining lymph nodes.

Cells were isolated aseptically from the tumor mass for culture. Briefly, the tumor was surgically excised and fat and necrotic tissue were dissected away from an unfixed section of the tumor. The mass was then minced into one millimeter cubes, placed in a 25 cm² cell culture flask (Nunc™, Wiesbaden, Germany), and left to adhere for 10 min at room temperature, with subsequent addition of minimum essential medium with Earle's salts supplemented with 2 mM glutamine, 50 U/mL penicillin G, 50 μg/mL streptomycin, 1 mM sodium pyruvate, 0.1 mM nonessential amino acids (MEM-C), and 10% FBS, then incubated at 37° C., 5% $CO_2$ and 100% humidity. Trypsinization and passage of the cultured cells were performed when cells covered approximately 80% of the flask surface or sooner if tissue explants were decaying. Once a primary culture was established, it was maintained in MEM-C with 10% FBS and incubated as above.

The cell type was analyzed by cytochemical and immunocytochemical stains. Briefly, primary cells were grown in 35 mm diameter plates (Nunc™) as described above. Then cells were trypsinized, collected in MEM-C with 10% FBS, and pelleted by centrifugation at 400×g for 5 min. The cellular pellets were suspended in 1 mL phosphate-buffered saline (PBS) from which 100 μL aliquots of cells were cytocentrifuged at 1000 rpm for 3 min onto charged glass sliders. Subsequently, the adherent cells were incubated for 10 minutes with BCIP/NBT phosphatase substrate (KPL, Inc., Gaithersburg, Md., USA) to detect alkaline phosphatase (ALP) activity, which is detectable in cells derived from bone, liver, kidney and intestine. Adherent cells also were immunostained directly with a murine anti-canine CD18 monoclonal antibody (CA16.3C10, from Dr. Peter Moore, University of California, Davis, CA), which is a marker for histiocytic cells. Additional slides were subjected to antigen retrieval in a decloaking chamber (Biocare Medical, Concord, CA) and incubated with a cocktail of murine monoclonal anti-AEL and anti-AE3 antibodies (Biogenex, San Ramon, CA) to detect cytokeratin (found within cells of epithelial origin) or with a murine monoclonal anti-vimentin antibody (V-9, Biogenex) (present in mesenchymal cells). The results showed that the cells were positive for vimentin, but negative for other proteins, which supports the soft tissue sarcoma diagnosis.

Multiplex species-specific PCR and short tandem repeat analysis also confirmed that the cells were of canine origin (O'Donoghue et al. (2011) J. Vet. Diagn. Invest., 23:780-785).

Example 15

Effects of LIVP 1.1.1, LIVP 5.1.1 and LIVP 6.1.1 on Various Canine Cancer Cell Lines and in Canine Xenograft Mouse Models 1. Therapeutic Effects of LIVP 1.1.1, LIVP 5.1.1 and LIVP 6.1.1 in Vitro Against a Panel of Canine Cancer Cell Lines Various canine cancer cell lines grown in 24-well plates were separately infected with with one of a vaccinia virus GLV-1h68, GLV-1h109, GLV-1h163, LIVP 1.1.1., LIVP 5.1.1. and/or LIVP 6.1.1 at a multiplicity of infection (MOI) of 0.1 or 1.0 as set forth in Table 70. The tested canine cancer cell lines were: STSA-1 (described in Example 14), DT08/40 (provided by Dr. Nolte, Small Animal Clinic, University of Veterinary Medicine Hannover, Germany), D17 (ATCC® #CCL-183™) or CHAS (provided by Dr. Greg Ogilvie, Angel Care Center, Carlsbad, Calif.). Cells were incubated at 37° C. for 1 hour with gentle agitation every 20 minutes. Then, the infection medium was removed and replaced with fresh growth medium. The virus supernatant and cell lystates were collected 1, 6, 24, 48, 72 and 96 hours post infection and various parameters associated with therapeutic effect were assessed, including viral replication and cytotoxicity.

TABLE 70

| Cell Line | GLV-1h68 | GLV-1h109 | GLV-1h158 | GLV-1h163 | LIVP 1.1.1 | LIVP 5.1.1 | LIVP 6.1.1 |
|---|---|---|---|---|---|---|---|
| STSA-1 | X | X | | | X | X | X |
| DT08/40 | | X | | | | | X |
| D17 | X | X | X | X | X | | X |
| CHAS | | X | X | X | | | X | a. Viral Replication

Following three freeze-thaw cycles of collected cell lysates, serial dilutions of the lysates were tittered by standard plaque assays on CV-1 cells as described above. All samples were measured in triplicate. The results showed that efficient viral replication was observed in all cell lines and by all tested virus strains. There was generally a greater than 100-fold titer increase over 48 or 72 hours.

b. Cytotoxicity

Cytotoxicity was assessed by measuring viablity of infected cells using an MTT-assay (Sigman, Taufkirchen, Germany). At 24, 48, 72 or 96 hours after infection of cells, medium was replaced by 0.5 mL MTT solution at a concentration of 2.5 mg/mL MTT dissolved in RPMI 1640 without phenol red and incubated for 2 h at 37° C. in a 5% $CO_2$ atmosphere. After removal of the MTT solution, the color reaction was stopped by adding 1 N HCl diluted in isopropanol. The optical density was then measured at a wavelength of 570 nm. Uninfected cells were used as a reference and were considered as 100% viable. Results are depicted in Table 71, and set forth the percent of cells killed at 72 hours post-infection (hpi; except for the cytotoxic activity of LIVP 6.1.1. on DT08/40, which was assessed at 96 hpi).

TABLE 71

| Cell Line | Canine Tumor type | Virus | Percent of Cells Killed at 72 hpi | |
|---|---|---|---|---|
| | | | MOI = 0.1 | MOI = 1.0 |
| STSA-1 | soft tissue sarcoma | GLV-1h68 | 60% | 77% |
| | | LIVP 1.1.1 | 82% | 86% |
| | | LIVP 5.1.1 | 92% | 93% |
| | | LIVP 6.1.1 | 73% | 83% |
| | | GLV-1h109 | 72% | 80% |
| CHAS | melanoma | GLV-1h109 | 29% | 84% |
| | | GLV-1h158 | 38% | 89% |
| | | GLV-1h163 | 18% | 84% |
| | | LIVP 6.1.1 | 100% | 100% |
| D17 | osteosarcoma | GLV-1h68 | 12% | 79% |
| | | GLV-1h109 | 12% | 80% |
| | | GLV-1h158 | 0% | 68% |
| | | GLV-1h163 | 0% | 66% |
| | | LIVP 1.1.1 | 12% | 54% |
| | | LIVP 6.1.1 | 54% | 87% |
| DT08/40 | prostate carcinoma | LIVP 6.1.1 | 55%* | 85%* |
| | | GLV-1h109 | 63% | 80.7% |

*cytotoxicity activity at 96 hours post-infection (hpi)

2. Effect of LIVP 1.1.1, LIVP 5.1.1 and LIVP 6.1.1 on Canine Growth and Therapy

A soft tissue sarcoma xenograft model (STSA-1), a canine melanoma xenograft model (CHAS), a canine osterosarcoma xenograft model (D17) and a canine prostate carcinoma xenograft growth model (DT08/40) were generated to test the effects of virus strains in vivo.

a. Canine Soft Tissue Sarcoma

The therapeutic effect of GLV-1h68, GLV-1h109, LIVP 1.1.1, LIVP 5.1.1 and LIVP 6.1.1 on the progression of soft tissue sarcoma tumors subcutaneous xenografts were evaluated in vivo by measuring tumor volumes in tumor-bearing mice treated with the virus twice a week for eight weeks (42 days post-viral infection). Tumors were generated by implanting $1\times10^6$ STSA-1 canine soft tissue sarcoma cells subcutaneously into the right hind leg of 6- to 8-week old female nude mice (NCI/Hsd/Athymic Nude-Foxn1$^{nu}$). Four weeks post implantation, all mice developed tumors with volumes of 400 to 500 $mm^3$.

1) GLV-1h68, LIVP 1.1.1, LIVP 5.1.1

On day 28, a single dose ($1\times10^7$ pfu) of GLV-1h68, LIVP 1.1.1 or LIVP 5.1.1 was injected intravenously into the lateral tail vein (i.v.). The control animals were injected i.v. with PBS only (n=6/group). Tumor volume was measured twice a week. Due to excessive tumor burden (>3000 $mm^3$), all animals of control group were killed at 21 days post-viral infection. The results show that systemic administration of GLV-1h68, LIVP 1.1.1 or LIVP 5.1.1 led to significant inhibition of tumor growth compared to control mice. While both LIVP 5.1.1 and GLV-1h68 slowed tumor growth compared to control animals, two of the six mice in each of these treatment groups developed tumors with volumes greater than 3000 $mm^3$ up to 35 days post-infection of virus. These data indicate that LIVP 1.1.1 had a higher oncolytic potential than GLV-1h68 or LIVP 5.1.1 against canine soft tissue sarcoma xenografts.

In a second set of experiments (n=4), a single i.v. injection of LIVP 1.1.1 into canine soft tissue sarcoma STSA-1 xenografts led to near-complete tumor regression over a 42-day period without observed toxicity.

Furthermore, in a long-term survival experiment, injection of LIVP 1.1.1 resulted in a significant improvement in survival of sarcoma-bearing mice compared to the PBS-treated control mice (P=0.0039 by two-way analysis of variance (ANOVA) with Bonferroni post-test).

2) GLV-1h109 and LIVP 6.1.1

The therapeutic effect of GLV-1h109 and LIVP 6.1.1 was assessed in the same model as described above. In this case, the medial start tumor volume before injection of virus was after five-weeks post-implantation where all mice developed tumors with volumes of 600 to 1000 $mm^3$, which represents a later stage of tumor development. Animals were separated into four groups (n=6/group) and were injected with a single dose of GLV-1h68 ($1\times10^7$ pfu), LIVP 6.1.1 ($1\times10^7$ pfu), LIVP 6.1.1 ($5\times10^6$ pfu) or PBS intravenously into the lateral tail vein. Tumor volume was measured twice a week. Due to excessive tumor burden (>3000 $mm^3$), all animals of control PBS group were euthanized after 14 days post-infection. The inhibition of tumor growth compared to control animals was generally the same for all virus-treated groups at all tested time points, and resulted in significant differences in tumor growth compared to controls. For example, at days 21, 28 and 35 post-infection, the tumor volume for all virus treated groups was between about 500 $mm^3$ to about 1000 $mm^3$, evidencing a substantial reduction in tumor burden compared to control animals. The results were similar between animals treated with $1\times10^7$ pfu or $5\times10^6$ pfu LIVP 6.1.1.

b. Canine Melanoma Xenograft Growth

The therapeutic effect of GLV-1h163 and LIVP 6.1.1 on the progression of canine melanoma tumors xenografts was evaluated in vivo by measuring tumor volumes in tumor-bearing mice treated with the virus once a week for over eight weeks. Tumors were generated by subcutaneously injecting $5\times10^6$ CHAS cell on right lateral thighs of male nude mice (Hsd/Athymic Nude-Foxn1$^{nu}$; Harlan, Indianapolis, Ind.). Three weeks post implantation, all mice developed tumors with volumes of 400 to 500 $mm^3$. Three weeks after implantation, groups of mice (n=5-6) were injected retro-orbitally with $2\times10^6$ pfu of LIVP 6.1.1 or GLV-1h163 or PBS. Tumor volume was measured once weekly. The results show that GLV-1h163, but not LIVP 6.1.1, resulted in a significant delay in tumor growth at 42 days post-infection. At 42 days post-infection, the tumor volume of GLV-1h163-treated mice was about 2000 $mm^3$, while the tumor volume of control mice or LIVP 6.1.1-treated mice was about 4000 $mm^3$. Mice from the control and LIVP 6.1.1-treated groups were euthanized at day 42.

c. Canine Osteosarcoma Xenograft Growth

The therapeutic effect of GLV-1h163 and LIVP 6.1.1 on the progression of canine osteosarcoma xenografts were evaluated in vivo by measuring tumor volumes in tumor-bearing mice treated with the virus once a week for over eight weeks. Tumors were generated by subcutaneously injecting $5\times10^6$ D17 cells on right lateral thighs of male nude mice (Hsd/Athymic Nude-Foxn1$^{nu}$; Harlan, Indianapolis, Ind.). Fourty-four days post implantation, groups of mice (n=5-6/group) were injected retro-orbitally with $2\times10^6$ pfu of LIVP 6.1.1 or GLV-1h163 virus. A control group of mice was administered PBS. The results show that treatment with both LIVP 6.1.1 and GLV-1h163 delayed the osterosarcoma growth beginning at 21 days post-infection. For example, at days 28-42 (measured at days 28, 35 and 42), the tumor volume of LIVP 6.1.1 or GLV-1h163-treated animals ranged from about 1200 mm$^3$ to 2500 mm$^3$, whereas control animals exhibited a steady increase in tumor growth at these time points with tumor volumes of about 2800 mm$^3$, 3800 mm$^3$ and 7800 mm$^3$, respectively.

d. Canine Prostate Carcinoma Xenograft Growth

The therapeutic effect of GLV-1h109 and LIVP 6.1.1 on the progression of canine prostate tumors were evaluated in vivo by measuring tumor volumes in tumor-bearing mice treated with the virus once a week for seven weeks. Tumors were generated by implanting 5×10$^6$ DT08/40 cells subcutaneously into the right hind leg of 6- to 8-week-old nude mice (NCl/Hsd/Athymic Nude-Foxn1$^{nu}$; Harlan, Winkelmann GmbH, Borchen, Germany). Forty-nine days after tumor cell implantation, groups of mice (n=7/group) were injected with 5×10$^6$ pfu of LIVP 6.1.1 or GLV-1h109 virus intravenously (i.v.) into the lateral tail vein. A control group of mice was administered PBS. The results show that a single injection with either LIVP 6.1.1 or GLV-1h109 vaccinia virus led to significant inhibition of tumor growth compared to control PBS animals beginning after day 14 post-infection and were similar between animal groups treated with the two viruses. For example, at days 21-49 (measured at days 21, 28, 35, 42 and 49), tumor volume of virus-treated animal groups generally was about 250 mm$^3$ to 300 mm$^3$. For control group of animals during these time points, tumor growth steadily increased with tumor volumes of about 380 mm$^3$, 440 mm$^3$, 480 mm$^3$, 580 mm$^3$ and 750 mm$^3$, respectively.

Since modifications will be apparent to those of skill in this art, it is intended that this invention be limited only by the scope of the appended claims.

SEQUENCE LISTING (329 sequences)

SEQ ID NO: 1 - DNA, 183369 bp, Artificial Sequence
  LIVP 1.1.1
tttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgtcgctgtctttctcttcttcgctacatctgatgtcgatagacacctcacagtctttgatcatagcaagagcttcttcatgagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaagacgggattacagtctttatgattcatagtaatagttagttccgacgttgagatggattcgctgagaccggtagtggtcgtccgagtacacgacgtgtcgttgacgggatacaggttaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgtcgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgtctgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatttgtggcgtttgcttcgtttaaataatatatcaaacatggagacgcctgatatgtagacattcttcattctattaatgtctactctatagcgctttagttccttatgacgaccggcgatatcatactttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttcgttttgttttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatagaaactggagaaatcaaaacattttcatccgtgtgttttaagattagttctttaaagatatccatggtatagaccaaacaataacgataacgatatatatcataaataaataatgttaaatttcagtttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataattatcaaatttattagtatcggttacatgaaggactttacgtagagtgacgattccactatctgtggtacgaacggtttcatcttctttgatgccatcacccagatgttctataaacttggtatcctcgtccgatctcatatcctttgccaaccaatacatgtagctaaaattaggcataaatttcacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtacgcttcttgttgtactgtaacttctggttttgttagatggttgcatcgtgctttaacgtcaatggtacaaattttatcctcgctttgtgtatcatattcgtccctactataaaattctatattcagattatcatgcgatgtgtatacgctaacggtatcaataaacggagcacaccatttagtcataaccgtaatccaaaaatttttaaagtatatcttaacgaaagaagttgtatcattgtctacggtgtatggtactagatcctcataagtgtatatatctagagtaatgtttaatttattaaatggttgataatatggatcgtcgtggcaatttcctaagatggaaatgagatatagacacgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgttgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaacagagaaatcagtttaggaaaaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatcaatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtaaataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacacaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttggtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttagccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttaaaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttattaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaaccggagtgggtaagacgtcacaggtacccaagttattgctttggtttaattatttatttggtggattctctactctagataaaattactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacattagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttaattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggaaagattagtaaattcaagattcctatctctgactatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaatttggtttcatgttttcgaaacggtattctgcaacaagtcggggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccatcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaataatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccgaggaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcatgtagtgggtcaaagaaaatcagatctgataatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatattttgcaaaatagtaatgattctatcttccttcgatagatattcttcagagattattgtcttatattctttcttgttatccgatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctataccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttccttagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtctccatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaacactttagtaattataagaaatatagacggtaatgtcatcatcaacaatccgataatatgcctgagagtaaacattgatggataaaacaaaaatgctccgcataactctatcatggcaataacacaaccaaacacttgtaaaattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcaacatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagaaataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataatttttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgtacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgacctatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagccgatatagatattaaacaagtgatacgtaagaatatactacaattgtctaatgatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatctggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtatacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattagaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaaggaatctacaggcataaaaataaaaatataatttataatatactcttacagcgcgccatcatgaataacagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagcgtaaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatttagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgttagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtacacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcgacaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattgattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaatactagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcaaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctgttatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgagatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctatcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttgattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttctgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataaatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtggagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatccacaacccattaaaaaaatggaaattaaagccctctattagcataaacggctacaggtctaccatcaggttaaccttcgtctaccttcacaatggcctttccttgtgcccagttcagaccctgtcattgccacgctactaaggactccctgaataccgtggccgacgtcagacattgtctgactgaatacatcctgtgggtttctcatagatggacccatagagaaagcgctcatctgttctccgtgtggtctcggaacatattctcacaccgtctcttccgcagataaatgcgaacccgtacccagaaatacctttaactatatcgatgtggaaattaatctgtatcccgtcaacgacacatcgtgtactcggacgaccactaccggtctcagcgaatccatctcaacgtcggaactaactattactatgaatcataaagactgtaatcccgtctttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactcatgaagaagctcttgctatgatcaaagactgtgaggtgtctatcgacatcagatgtagcgaagaagagaaagacagcgacatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaa

SEQ ID NO: 2 - DNA, 193964 bp, Artificial Sequence
  LIVP 2.1.1
gagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagaataaaaatattttatgactccattgaagagagaaaaagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagaaaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgtctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaagacgggattacagtctttatgattcatagtaatagttagttccgacgttgagatggattcgctgagaccggtagtggtcgtccgagtacacgacgtgtcgttgacgggatacaggttaatttccacatcgatatagttaaaggtattactgggtacgggttcgcatttatctgcggaagagacggtgtgagaatatgttccgagaccacacggagaacagatgacgtctccggatactccgtatcctattctacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgtcgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatttgtggcgtttgcttcgtttaaataatatatcaaacatggagacgcctgatatgtagacattcttcattctattaatgtctactctatagcgctttagttccttatgacgaccggcgatatcatactttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttcgttttgttttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagatttgacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaattttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatctcatatcctttgccaaccaatacatgtagctaaaattaggcataaatttcacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtagaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaagagatggtttccttatcatttctccatagtggtacaatactacacattatttcgtgcggctttccattttccaaaaacaatttgaccaaatctacatctttattgtatctataatcactatttagataatcagccataattcctcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataatttcaggaacaggatcatctgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacttgtacatcactgtaagcatgtccttaccatttattttaatttgacgcatatccgcaatttctttttcgcagtcggttataaattctatatatgatggatacatgctacatgtgtacttataatcgactaatatgaagtacttgatacatatttccagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacgacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaattatctatctacatcatcacgtctctgtattctacgatagagtgctactttaagatgcgacagatctgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatttttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatcaatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatctaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgacgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcatttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacaaccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaataattacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaagagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtaaataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacccgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattacctgcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttaaagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgttggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggttttttagcttgtgattttttcttttgcggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttaaaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttattaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaatgaatttaaatcatcttatttagaaagcgttccgttaccctgccaattaatgtacgcgttagaaccacgtaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgaatgttataaaaatgccggtattgatacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttctttatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataattaataatattatcttatatcttatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagataatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctatctaaatttcgttgaaccggaagaattgaatcttagtaagtttataatggttcttccgggggcagccaacaagggcaagattagtaaattcaagattcctatctctgactatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaatttggtttcatgttttcgaaacggtattctgcaacaagtcggggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcttctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataagaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtaaatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgactgttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctatcacgtcatatatttatggcttctccagagaatgtaattctttctccgcctattaacgcgcctataaaaacctttatgttgcctaaacaagatatagtaggtctggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcccgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaataatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccgaggaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcatgtagtgggtcaaagaaaatcagatctgataatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacaaaaaatatcatgttcctattatgaaactatatcctacaccggaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatgcagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaaaaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgaaaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaaaattgttctcttagtggcatcgctatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaatgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagaatgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagacgccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaatacagactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaacagcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgttaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagctttgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccttatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcacacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaaaatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgtatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagccgatatagatattaaacaagtgatacgtaagaatatactacaattgtctaataatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatccgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatggttaaaattaacaaggatcccaaaaaaattccagagtggttggtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacatcggcggacaatctaaaaacaatacagtgattgcagatttgccatatctggataatgcggtatccgatgtatgcaattcactgtataaaaagaatgtatcaagaatatccagatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgtaggcaaatttggatctagtatgttggggaaatatgaacctgacatgattaagattgctctttcggtggctggtaatttaataagaaatcgagactacattcccgggagacgaggctatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctgacgcgataaattcgtaataatctgttttgttcaaaggaatctacaggcataaaaataaaaatataatttataatatactcttacagcgcgccatcatgaataacagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatactctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattattattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaacggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgaacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagaaaatattctgttgtgttagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcacttagtccaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaattaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcaaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgagatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctatcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctcctataactaatgatgtatctacacaaacatgggaaaagaaatcagagttagatagatacatggaatcgtatcctcgtcatagatatagtaaacattctgtatttaagggattttctgataaagttagaaaaaatgatttagacatgaatgtggtaaaagaattactttctaacggtgcatctctaacaatcaaggatagcagtaataaggatccaattgctgtttattttagaagaacgataatgaatttagaaatgattgatattattaacaaacatacaactattgatgaacgaaagtatatagtacactcctatctaaaaaattatagaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaaccaactcagaaatggttgttgtattattgggtgtataggtattattagctatgtaccaatttaccaaccctcttaatattgattgataatcacatcggttatccaatcaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtcaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaaaacaaaacgaagctagttgatttattactgagttaccatcccactctagagactatgattgacgcatttaatagagatatacgctatctatatcctgaaccattattcgcctgtatcagatacgccttaatcctagatgatgattttccttctaaagtaaagtatgatatcgccggtcgtcataaggaactaaagcgctatagagtagacattaatagaatgaagaatgtctacatatcaggcgtctccatgtttgatatattatttaaacgaagcaaacgccacaaattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacgacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtagaataggatacggagtatccggagacgtcatctgttctccgtgtggtctcggaacatattctcacaccgtctcttccgcagataaatgcgaacccgtacccagtaatacctttaactatatcgatgtggaaattaacctgtatcccgtcaacgacacgtcgtgtactcggacgaccactaccggtctcagcgaatccatctcaacgtcggaactaactattactatgaatcataaagactgtaatcccgtctttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcagacacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattttctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctttttctctcttcaatggagtcataaaatatttttattctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctc

SEQ ID NO: 3 - DNA, 203057 bp, Vaccinia virus
  GLV-1i69
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgcagatctcgagttatgatctacttccttaccgtgcaataaattagaatatattttctacttttacgagaaattaattattgtatttattatttatgggtgaaaaacttactataaaaagcgggtgggtttggaattagtgaaagcttaaaaattgaaattttattttttttttttggaatataaataagctcgaagtcgacagatctaggcctggtaccaggaggaggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgccctgctagcaagcttgctagcggccgctcgagatctgcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggtggtggtgcaaatcaaagaactgctcctcagtggatgttgcctttacttctaggcctgtacggaagtgttacttctgctctaaaagctgctgcagggggggggggggggtgggggggccggttagggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtatcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaaaaaaaaaaaaaaaaaaaaaaaaaaaaaaaaaaaaaaaaaaaaaaaaaaaaaaaaaaaaaaaaagtaccttctgaggcggaaagaaccagccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatctagataccaacattaaaatgtctacagataatgcggtttatcagtgtcgtaaattacgagctagattgcctagacctgatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttgaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcggtacccggggatcagcttgcatgcctgcagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacattctagtcgaggaattcatttatagcatagaaaaaaacaaaatgaaattctactatatttttacatacatatattctaaatatgaaagtggtgattgtgactagcgtagcatcgcttctagacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtgacggatccccgatccccgacctgcaggcatgcaagctcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgtcgtagaaacactgaagctaacgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 4 - DNA, 187653 bp, Artificial Sequence
  LIVP 4.1.1
agaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccagtacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacagattatggcgtttgtattcgttgtctttacactttccatcggatggtgcatgcggtgctatatctcttccgtttattattatacatgagagaaacaatatatacgagtataatacggacttcataatttaataatgtagtaatcgttgtcttgttcctgtttcctacttctccaatcatggataatatttgtaatggttctttccgtacaacatactgtttagatgatattgcgcataatttccggaggcaaatacgatagtctagattggccatcgatggtagactctaatttattgagtgctttgtcgacgagtttcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggagacgcctgatatgtaggcattcttcattctattaatgtctactctatagcgctttagttccttatgacgaccggcgatatcatactttactttagaaggaaaatcatcatctaggattaaggcgtatctgatacatgccgataatggttcaggatatagatagcgtatatctctattaaatgcgtcaatcatagtctctagagtgggatggtaactcagtaataaatcaactatcctcgttttgttttctctttggtaactgcttttctggatggccgtattgattatcgagcgtgatgttgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatatgtgatttacagccgcgtgtccatattttccacgataaaccttacgacgtttacatcgacgagattattattaacaaagtagtcgtgtagaggatagttgttgtccgtcgtcttatccatggttgctccgttatctaacatgcattgaatgataggtatacttaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagccaaatattcttttttgaaacgccatctatcgtagtgaggacacaagtgaacctataattatcaaatttattagtatcggttacatgaaggactttacgtagagtgacgattccactatctgtggtacgaacggtttcatcttctttgatgccatcacccagatgttctataaacttggtatcctcgtccgatctcatatcctttgccaaccaatacatgtagctaaaattaggcataaatttcacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacgtttaacaagttgaccaattcatttttaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagataggttatatccgtacttgcacttaaagtttacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtaaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatcaatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaatagccaaacggcgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgattttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgacgttcgtacccatcttgatgcggtttaataaatgttttgatttcaatttattgtaaaaaaagattcggttttatactgttcgatattctcattgcttatattttcatctatcatctccacacagtcaaatccgtggttagcatacacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtaaataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacccgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctttatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggttttttagcttgtgattttttcttttgcggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaacttttaggtggagttctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaataaaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacaagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatatgttccctctgcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatcaacatatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgactgttataaaaatgccggtattgatacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctagcattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgctggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactaccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggtgccgccaacaagggaaagattagtaaattcaagattcctatctctgactatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcgatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcttctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtcaccgtattatcgtaattcagtagccagacaactggtcaataatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagctagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataaaatttctaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccgaggaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcatgtagtgggtcaaagaaaatcagatctgataatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagatttgcatttctatacttgttggtgaaatggtacagaaaatatcatgttcctattatgaaactatatcctacaccggaagagattcctgactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataagaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaatacagactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgtttttaagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccttatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaacactttagtaattataagaaatatagacggtaatgtcatcatcaacaatccgataatatgcctgagagtaaacattgatggataaaacaaaaatgctccgcataactctatcatggcaataacacaaccaaacacttgtaaaattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatccgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatagtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaatagatcaacagaaatatttaatcctccgtttgatacagatgcgccatatttatggatttcggattcacacgttgtttgtctgaggtgttcgtctagcgttgcttctacgtaaacttcgattcccatatattctttattgtcagaatcgcataccgatttatcatcatacactgtttgaaaactaaatggtatacacatcaaaataataaatactaacgagtacattctgcaatattgttatcgtaattggaaaattagtgttcgagtgagtcggattatgtgagtactggattttatattttgtaataagaataaaatgctaatgtcaagtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaaaatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgtatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcatcactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagtttcttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctcatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacatcggcggacaatctaaaaacaatacagtgattgcagatttgccatatctggataatgctgtatcggatgtatgcaattcactgtataaaaagaatgtatcaagaatatccagatttgctaatttgataaagatagatgacgatgacaagactcctactggtgtatataattattttaaacctaaagatgccattcctgttattatatctataggaaaggatagagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtctactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctgacgcgataaattcgtaataatctgttttgttcaaaggaatctacaggcataaaaataaaaatataatttataatatactcttacagcgcgccatcatgaataacagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagcgtaaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatttagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagtcacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcgacaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaattaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatatgccgtctctatctaatggattaatttccggatctacattttctatcggtggcgttatacatcttagttgtaaaagtggttttacactaacggggtctccatcatccacatgtatcgacggtaaatggaatcccgtactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttgatctccgttatagtattagtttgttcctgtgacaaaaataatgaccaatataagttccataaattgctaccgtaaatataaatccgttaaaataattaataacgaacaagtatcaaaagattaaagacttatagctagaatcaattgagatgtcttcttcagtggatgttgatatctacgatgccgttagagcatttttactcaggcactattatgacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggactacgattcatggaaatgtttttcgattacaataaaaatagtatcaacaatcaactaatgtatgatataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatataaatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaaaggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacaatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaattatattcttttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcgagctatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggttcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacagttacaaatgagttctgtgcagatcatccgttcatctatgtgattaggcatgttgatggcaaaattcttttcgttggtagatattgctctccaacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctcttctccctttcccagaaacaaactttttttacccactataaaataaaatgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgttacatcctttattaaatcatgaatgggaatttctatgtcatcgttagtatattgtgaacaacaagagcagatatctataggaaagggtggaatgcgatacattgatctatgtagttttaaaacacacgcaaactttgaagaatttatataaatcattccatcgatacatccttctatgttgagatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgcaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttgattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttctgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataaatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtgaagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatccacaaccccattaaaaaaatggaaattaaagccctctattagcataaacggctacaggtctaccatcaggttaaccttcgtctaccttcacaatggcctctccttgtgcccagttcagaccctgtcattgccactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggagttctcggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagcatacagtaagcatagatacgtaaaatctcagattgtgcatctactgatatccagctattcaaattcctctaacgaactcaagtcgaatataaatgatttcgatctgtattcgtataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatgttgataaactacttacattacggcgatatggtaagtatacctatcattcaatgcatgttagataacggagcaaccatggataagacgacggacaacaactatcctctacacgactactttgttaataataatctcgtcgatgtaaacgtcgtaaggtttatcgtggaaaatatggacacgcggctgtaaatcacatatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgtcacaacatcacgctcgataatcaatacggccatccagaaaagcagttaccaaagagaaaacaaaacgaggatagttgatttattactgagttaccatcccactctagagactatgattgacgcatttaatagagatatacgctatctatatcctgaaccattatcggcatgtatcagatacgccttaatcctagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgaaactcgtcgacaaagcactcaataaattagagtctaccatcgatggccaatctagactatcgtatttgcctccggaaattatgcgcaatatcatctaaacagtatgttgtacggaaagaaccattacaaatattatccatgattggagaagtaggaaacaggaacaagacaacgattactacattattaaattatgaagtccgtattatactcgtatatattgtttctctcatgtataataataaacggaagagatatagcaccgcatgcaccatccgatggaaagtgtaaagacaacgaatacaaacgccataatctgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtactggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttct

SEQ ID NO: 5 - DNA, 188863 bp, Artificial Sequence
  LIVP 5.1.1
cgattaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaatcctgaagttgctaccttattaagaacggagaagtatccatcacgaaagacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaacagaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatttgtggcgtttgcttcgtttaaagaatatatcaaacatggagacgcctgatatgtagacattcttcattctattaatgtctactctatagcgctttagttccttatgacgaccggagatatcatactttactttagaaggaaaatcatcatctaggattaaggcgtatctgatacaggcgaataatggttcaggatatagatagcgtatatctctattaaatgcgtcaatcatagtctctagagtgggatggtagctaagtaataaatcaactatcctcgttttgttttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgtagaggatagttgttgtccgtcgtcttatccatggttgctccgttatccaacatgcattgaatgataggtatacttaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataatttaacaatctctatatctatggttgagcaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatctgagatttgacgtatctatgcttactgtatgctcctagcggagttaatccttcgttgtttctacaaagtctctcgactccgcgagagagtaacagccgaacaatcttaatgtctgtatcgcatttattgaagacgtaacaatgtagcgcattgtttcctcgtctatctatatgttttgataagttgtgacacgtttcaatctctggttttatttttttgtacgtcacatcttcatccagtagacgacatagaatagtgcactctctaccacaataatccatagctattctggtgctaattattcctatttcacgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaaattcaattcaattcgttgtttctaatataatctgccgtattggatggattctcaagacaattgcatttagattatattatcatgaataaaaatagtagcacacaactacttcagcaaacattctttttataaatgccatctagcgtagcgaggacacaagtgaacctataattatcaaatttattagtatcggttacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacttgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgcttccatcggtataaaaatcctcgtatccgttatgtcttccgttggatatagatggaggggattggcatttaacagattcacaaataggtgcctcgggattccataccatagatccagtaaatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacatattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtaaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccattttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccaacataatgttgtccattgtagtataaaaattaatatttctatttctatttctgtatatttgcaacaatttactctctataacaaatatcataacttagttcttttatgtcaagaaggcactggtttagttcatctataaatgtcacgccataactactacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcagtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttatcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcttctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccattcggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatagttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacacaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggttttttagcttgtgattttttcttttgcggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttaaaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttattaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacattagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctgggacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttattaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgaatgttataaaaatgccggtgttgaaacatcgtctaaacgaatattgggtaaaaatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgctggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggaaagattagtaaattcaagattcctatctctgactatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcgatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaatttggtttcatgttttcgaaacggtattctgcaacaagtcggggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcttctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcccgtgaatgcaatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatataaaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaataatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccgaggaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaaaaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcagcagactccggataaccagtcggtggaccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaaaatatcagacgatccacaatcaaagaattggtctccgagtttgtaacagacagcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcatctatagaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttttacaaaatccagtcatgaaatcatcacaatgttctgtcttgtaattattattaaatatttttggacagtgtttggtatttgtcttagaacaacattttgctacgctatcactatcgcccaggagataatccttttttataaaatgacatcgttgcccggatgctatataatcagtggcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggacaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaagacctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgttacaccactactaatcggttcggtaacgtctgtggacgatggaggcaccacttctacagaacctgtagcctcagttgtcaacggagatacatttttaatgcgagaaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagattccaattcacgttcgcatgggttacctccgcagtttttacgagcgatttcacgttcagccttcatgcgtctctccctctctttatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccttatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaattagtgttcgagtgagttggattatgtgagtattggattgtatattttattttatattttgtaataagaataaaatgctaatgtcaagtcttattaaaaacatatataataaataacaatggctgaatggcataaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgcgcaactggtaattaaaataaaaagtaatattcatatgtagtgtcaattttaaatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatactatctataaaaataagtatataataaatactttttatttacggtactcttgtagtggtgataccctactcgattatttttttaaaaaaaaaatacttattctgattcttctaaccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcaacatttcctacatatacccggctatgcaccgcgtcatcatcgactgtacgatacataatgttaccgtgttgcttacattgctcgtaaaagactttcgtcaatttgtctccttctccgtaaattctagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttaataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaaaatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgtatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcatcactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagtttcttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacatcggcggacaatctaaaaacaatacagtgattgcagatttgccatatctggataatgctgtatcggatgtatgcaattcactgtataaaaagaatgtatcaagaatatccagatttgctaatttgataaagatagatgacgatgacaagactcctactggtgtatataattattttaaacctaaagatgccattcctgttattatatctataggaaaggatagagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggctatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctacttcgtcaccaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctgacgcgataaattcgtaataatctgttttgttcaaaggaatctacaggcataaaaataaaaatataatttataatatactcttacaacgccatcatgaataacagcagtgaattgattgctgttattaatggatttagaaatagtggacgattttgtgatattagtatagttattaatgatgaaaggataaacgctcataaactcatcctatctggagcctccgaatatttttccattctgttttccaataattttatcgattctaatgaatacgaagttaatctaagtcatttagattatcaaagtgttaacgatttgatcgattatatttatgggatacctttgagcctaactaacgataacgtgaaatatattctttcaaccgctgattttttacaaattggatctgccattactgagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatactctacaccttctcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgatacagtaccaccaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgtcgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgtagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcgacaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaattaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccgtactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtgaatataaatccgttaaaataattaataatttaataacgaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctgttatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgagatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattaaaggaagaggatatcgatgagaacatagtatccactttattagataagggaatcgatcctaactttaaacaagacggatatacagcgttacattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctatccaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttgattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttttgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtgaagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatctacaaccccattaaaaaatggaaattaaagccctctattagcatagacggctacaggtctaccatcaggttaaccttcgtctaccttcacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcgtgaaataggaataattagcaccagaatagctatggattattgtggtagagagtgcactattctatgtcgtctactggatgaagatgtgacgtacaaaaaaataaaaccagagattgaaacgtgtcacaacttatcaaaacatatagatagacgaggaaacaatgcgctacattgttacgtcttcaataaatgcgatacagacattaagattgttcggctgttactctctcgcggagtcgagagactttgtagaaacaacgaaggattaactccgctaggagcatacagtaagcatagatacgtcaaatctcagattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtcttgctcaaccatagatatagagattgttaaattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatgttgataaactacttacattacggcgatatggtaagtatacctatcattcaatgcatgttggataacggagcaaccatggataagacgacggacaacaactatcctctacacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaaaacaaaacgaggatagttgatttattacttagctaccatcccactctagagactatgattgacgcatttaatagagatatacgctatctatatcctgaaccattattcgcctgtatcagatacgccttaatcctagatgatgattttccttctaaagtaaagtatgatatctccggtcgtcataaggaactaaagcgctatagagtagacattaatagaatgaagaatgtctacatatcaggcgtctccatgtttgatatattctttaaacgaagcaaacgccacaaattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttctgtttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtctttcgtgatggatacttctccgttcttaataaggtagcaacttcaggattctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttaatcg

SEQ ID NO: 6 - DNA, 188082 bp, Artificial Sequence
  LIVP 6.1.1
tcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaagacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttgacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatctacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggaaacgcctgatatgtagacattcttcattctattaatgtctactctatagcgctttagttccttatgacgaccggcgatatcatactttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttcgttttgttttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgtcgtcttatccatggttgctccgttatccaacatgcatcgaacgaccatatcgccgtaatgtaagtagtttatcagtatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatttgagatttgacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttacgattagttctttaaagatatccatggtatagacctaacgataacgatatatatcataaataaataatgttaaatttcagtttatgtttgtaccccgtattcatacttaacaaattggtattgcgtacacaatcaatcatattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatctcatatcctttgccaaccaatacatgtagctaaaattaggcataaatttcacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatatcacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtaaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatcaatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtaactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacagtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattacatgttttcatattcattaggattatcaaatctttaatcttattacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgagaacggacatgctacaaaatatgttcgcggctaatcgcgacaacgtggcgtcgagacttttgtcctaaaatacaattatatctttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcgtaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtttccagagctcgctctatcttttattttatctaattcgatacaaactcctgatactggttcagaaagtaattcattaattttcagtcctttatagaagatatttaatatagataatacaaaattttcagttcttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtaaataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaagaatcttcaagagtgcattgactttgttagtgaataggcatttcatctttctccaatactaattcaaattgttaaattaataatggatagtataaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacccgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacgatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaatgcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggttttttagcttgtgattttttcttttgcggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttaaaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaatttcttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcctgtcaaccaaccgaatggagtaaaataaatatcattaatatatgctctagatattagtatttttattaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgcgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctcttttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatatttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttaatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctatctaaatttcgttgaaccggaagaattgaatcttagtaagtttatgatggttcttccgggggcagccaacaagggaaagattagtaaattcaagattcctatctctgattatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaattaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttattacacgctattaatcatccaaagtcaaggcctaatacatctctggaaatagaattcacacctagagacaatgaaacagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctgaagatatacccgaagatatacacactgataaatttgtcatttatgatatatacacttttgattcgttcaagaataaacgattggtatttgtacaggtacctccgtcgttaggagatgatagtcatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtatctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccgaggaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcatgtagtgggtcaaagaaaatcagatctgataatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtggaccatcgctaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggtcaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaatacccaacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcaggaagattagtcagaccattcttggttgtggataacggagagctcatgatggatgtgtgtccggagttagaaagcagattagacgacatgacattctctgacattcagaaagagtttccgcatgtcattgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccttatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagacctgatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaacactttagtaattataagaaatatagacggtaatgtcatcatcaacaatccaataatatgcctgagagtaaacattgatggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattccataatcaatgagacatcactatccgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatatcacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataacactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgcagtcacatcgtttacgcaatagtcagactgtagttctatcatgcttcctacattagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaatagatcaacagaaatatttaatcctccgtttgatacagatgcgccatatttatggatttcggattcacacgttgtttgtctgaggtgttcgtctagtgttgcttctacgtaaactttgattcccatatattctttattgtcagaatcgcataccgatttatcatcatacactgtttgaaaactaaatggtatacacatcaaaataacaaatactaacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataataaacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtctcatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcactgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgacctatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctaccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacatcgacggacaatctaaaaacaatacagtgattgcagatttgccatatctggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctgacgcgataaattcgtaataatctgttttgttcaaaggaatctacaggcataaaaataaaaatataatttataatatactcttacagcgcgccatcatgaataacagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagcgtaaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatactctacaccttctcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagtcacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaacggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgaacctagagaattgctgcaatatattaccatggtaaactctttgacatattttgaggaacccaattacgacgagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaattaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcagtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgaaataaaactgcatattatacactggttaacgcccttataggctctaaccattttcaagatgaggtccctgattatagtccttctgttcccctccatgtctattagacgatgtgagaagactgaagaggaaacatggggattgaaaatagggttgtgtataattgccaaagatttttatcccgaaagaactgattgcagtgttcatctcccaactgcaagtgaaggattcagggatatacgaaacaccgataaattataaaaaaagcaatgtgtccgctgtttccgttaataatactattttcgtaactggcggattattcataaataactctaatagcacgatcgtggttaacaatatggaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatataaatagtttttatgtatagcagtattaccctatagttttattgcttactactaacatggatacagatacagatacagatacagatacagatacagatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaatacaagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtttgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcgaaatatgtagaaacggaggagaacacggataaggttagcgctcaaaatatctcattcaaatccataaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttctttcttctcttctccctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataataatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatgcagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgagatgtatatatccaggaattcttttattaatgtcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttgattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttctgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataaatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtggagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatccacaacccattaaaaaaatggaaattaaagccctctattagcataaacggctacaggtctacctttacaatggcctctccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatactgataaactacttacattacggcgatatggtcgttcgatgcatgttggataacggagcaaccatggataagacgacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaaaacaaaacgaagctagttgatttattactgagttaccatcccactctagagactatgattgacgcatttaatagagatatacgctatctatatcctgaaccattattcgcctgtatcagatacgccttaatcctagatgatgattttccttctaaagtaaagtatgatatcgccggtcgtcataaggaactaaagcgctatagagtagacattaatagaatgaagaatgtctacatatcaggcgtttccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggtttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtattttacgttctttgatgtagatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagtcaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtctttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttga

SEQ ID NO: 7 - DNA, 188082 bp, Artificial Sequence
  LIVP 7.1.1
atttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcacgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgcgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaatcctgaagttgctaccttattaagaacggagaagtatccatcacgaaatacgggattacagtctttatgattcatagtaatagttagttccgacgttgagatggattcgctgagaccggtagtggtcgtccgagtacacgacgtgtcgttgacgggatacagattaatttccacatcgatatagttaaacgtattactgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatttgtggcgtttgcttcgtttaaataatatatcaaacatggagacgcctgatatgtagacattcttcattctattaatgtctactctatagcgctttagttccttatgacgaccggcgatatcatactttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttcgttttgttttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctctcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacacaactacttcagcaaatattcttttttgaaacgccatctatcgtagtgaggacacaagtgaacctataatgagcaaatttattagtatcagtcacatgaaggactttctgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatttaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtagaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaagagatggtttccttatcatttctccatagtggtacaatactacacattatttcgtgcggctttccattttccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtaaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatcaatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacaagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttatttcctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccgcctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagttttatagatagataatcaaaattgtctatgatgtcatcttctagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttagactgtgaatgtcaaggtctagacaaacccttgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtttccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaaacataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtaaataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacccgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatataaatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcctattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttttttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtactgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctaaatattagtatttttatcaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttttaccgaggagccgaaaacattgtgtttaatcttccggtgtccaaggtaaaatcgtgtttgtgtagttttcacaatgatgccatcatagatatagaacctgatctggaaaataatctagtaaaactttctagttatcatgtagtaagtgtcgattgtaataaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagttaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgactactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcgatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactttaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcagtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaataatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttcttgcgaatatcgtcgattcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcatctatagaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctttttcaacactcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcgatttgatgaacacacgatgaaaatgtgcttctatgagattgatcatgtagaaaacaacaagggatacaatattttcgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctcttgccacccagataaccaaaaagtcacacgctccaggatatacattgtataaaaagctatcgttttttagtagtgtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctattaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccaatcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtgaaggtgtaactgctacttgggatactgaagtctgatattcagaaagctgtggatgttctggttcgacatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccttatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccacagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatactatctataaaaataagtatataataaatactttttatttacggtactcttgtagtggtgataccctactcgattatttttttaaaaaaatacttattctgattcttctaaccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcaacatttcctacatatacccggctatgcaccgcgtcatcatcgactgtacgatacataatgttaccgtgttgcttacattgctcgtaaaagactttcgtcaatttgtctccttctccgtaaattctagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagaaataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggatgaatttgattattttgaagacgatgattcgtctacatgttctgccgtaaccgacagggaaacggatgtataattttttttatagcgtgaaggatatgataaaaaatataattgttgtatttatcccattctaatcaccttatatgattctgtaacacaataaaggagtctcatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggtcgcacgcgacttttctctaaaggatgatgttgcccaagatcctctcttaaatgaatccatcttatccttggacaagatggacagtctattttccttagatggtttaatatttttgttacccatgatctataaaggtagacctaatcgtctcggatgacctatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagacgtggatagtttcttaactacgttatcatccgtaactaaagaatcgcatcaaataaaattattgactgatattgcatccgtttgtacatgtaatgatttaaaatgtgtagtcatgcttattgataaagatctaaaaattaaagcgggtcctcggtacgtacttaacgctattagtcctcatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacatcggcggacaatctaaaaacaatacagtgattgcagatttgccatatctggataatgctgtatcggatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatttagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagtcacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtacacttagtccaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcctataccgagtactgtaaaaacaaatttgtacatgaagactatgggatcatgcattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaattaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttccagaaacaaactttttttacccactataaaataaaatgagtatactacctgttatatttttttattcttcattcgttcagacttttaacgcgcctgaatgtatcgacaaagggcaatattttgcatcattcatggagttagaaaacgagccagtaatcttaccatgtccttaaataaatacgctatcatccggatataatatattagatattttatgggaaaaacgaggagcggataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatgcagagtatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgagatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctatcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttaattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttctgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtgaagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatctacaacccattaaaaaaatggaaattaaagccctctattagcatagacggctacaggtctaccttcacaatggcctttccttgtgccaagttcagtccctgtcattgccacgctactaaggactccctgaataccgtggccgacgtcagacattgtctgactgaatacatcctgtgggtttctcatagatggacccatagagaaactgcagggtctctctacaggcttctcatctctttcagaactgatgcaacggagctctttggtggtgagttgaaggattcacttccgtgggacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgagagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaaaacaaaacgaagctagttgatttattactgagttaccatcccactctagagactatgattgacgcatttaatagagatatacgctatctatatcctgaaccattattcgcctgtatcagatacgccttaatcctagatgatgattttccttctaaagtaaagtatgatatcgccggtcgtcataaggaactaaagcgctatagagtagacattaatagaatgaagaatgtctacatatcaggcgtctccatgtttgatatattatttaaacgaagcaaacgccacaaattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagtaatacgtttaactatatcgatgtggaaattaatctgtatcccgtcaacgacacgtcgtgtactcggacgaccactaccggtctcagcgaatccatctcaacgtcggaactaactattactatgaatcataaagactgtaatcccgtatttcgtgatggatacttctccgttcttaataaggtagcaacttcaggattctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcgcggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcgtgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaat

SEQ ID NO: 8 - DNA, 188768 bp, Artificial Sequence
  LIVP 8.1.1
atcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatttgtggcgtttgcttcgtttaaataatatatcaaacatggagacgcctgatatgtagacattcttcattctattaatgtctactctatagcgctttagttccttatgacgaccggcgatatcatactttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttcgttttgttttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatgctcctagcggagttaatccttcgttgtttctacaaagtctctcgactccgcgagagagtaacagccgaacaatcttaatgtctgtatcgcatttattgaagacgtaacaatgtagcgcattgtttcctcgtctatctatatgttttgataagttgtgacacgtttcaatctctggttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatctcatatcctttgccaaccaatacatgtagctaaaattaggcataaatttcacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatacgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtaggcttcttgttgtactgtaacttctcgttttgttagatggttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcatgacaatttcctaagacgaaaataagacataaacacgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaaaaaaaattatctatctacatcatcacgtctctgtattctacgatagagtgctactttaagatgcgacagatctgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatatcacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtaaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattgtttagttcatccttgttcattgttaggaatctatccaaaatggcaattatactagaactataggtgcgttgtatacacatattgatgtgtctgtttatacaatcaatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcgggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatcccttttttagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtatttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgctacagacacgaatatgactagaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaacccacgtaacattagaattaattatcgatagtaatgcatcaacgcttccaaaattgtctattataaactcaccgataatttttttattgcatgttttcatattcattaggattatcaaatctttaatcttattacgattgtatgcgttgatattacaagacgtcattctaaaagacggaggatttccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagttccgtttatgagaacggacatgctacaaaatatgttcgcggctaatcgcgataatgtagcttctagacttttgtcctaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtttccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatataatttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtacccaagaagtttatctactgccaatttagctgcattatttttagcatctcgtttagattttccatctgccttatcgaatactcttccgtcgatatctacacaggcataaaatgtaggagagttactaggcccaactgattcaatacgaaaagaccaatctctcttagttatttggcagtactcattaataacggtgacagggttagcatctttccaatcaataatttttttagccggaataacatcatcaaaagacttatgatcctctctcattgatttttcgcgggatacatcatctattatgacgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacacaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggattcattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacccgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatctttctccggtagatacgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgtatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcttcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggttttttagcttgtgattttttcttttgcggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttaaaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttattaatcctttgattatcatcttctcgtaggcgaatgattccatgatcaagagtgatttgagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcttaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatcaacatatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgctgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattctaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttatattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaataaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggaaagattagtaaattcaagattcctatctctgactatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcgatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtaaacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaatttggtttcatgttttcgaaacggtattctgcaacaagtcggggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcttctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatatttgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcagaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaataatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccgaggaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcatgtagtgggtcaaagaaaatcagatctgataatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaatgatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtggaccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacagacagcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtagatgctacttcatctatagaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattctaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatccgatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttgagtttgtcgcatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccttatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataaaatcgtagatctcccatgtggcggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaattcgagtacaccacacgacaatgaacaaacataagacagattatgctggttatgcttgctgcgtaatatgcggtctaattgtcggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatactatctataaaaataagtatataataaatactttttatttacggtactcttactgtgtagtggtgataccctactcgattatttttttaaaaaaatacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcgtcaatttgtctccttctccgtaaattctagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgacctatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatcaataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcgttctctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgtatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagaccgagttgattaattcattagacgacaatgaaattatcgattgtatagttaataagtttatgagcttttataaggataacctagaaaatatagtagatgctatcatcactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagacgtggatagtttcttaactacgttatcatccgtaactaaagaatcgcatcaaataaaattattgactgatattgcatccgtttgtacatgtaatgatttaaaatgtgtagtcatgcttattgataaagatctaaaaattaaagcgggtcctcggtacgtacttaacgctattagtcctcatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccagtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctgacgcgataaattcgtaataatctgttttgttcaaaggaatctacaggcataaaaataaaaatataatttataatatactcttacagcgcgccatcatgaataacagcagtgaattgattgctgttattaatggatttagaaatagtggacgattttgtgatattagtatagttattaatgatgaaatgataaacgctcacagactcatcctatctggagcctccgaatatttttccattctgttttccaataattttatcgattctaatgaatacgaagttaatctaagtcatttagattatcaaagcgtaaacgatttgatcgattacatttatgggatacctttgagcctaactaacgataacgtgaaatatattctttcaaccgctgattttttacaaattggatctgccattactgagtgcgaaaaatacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatttagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagtcacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaataatactgcgactttgttaatgaccagtttgcaatatgaacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcgacaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaattaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggaaattctaaagaaccagtaccatatgatatcgatgactacgattgcacgtctacaggttgcagcatagactttgccacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgaaataaaactgcatattatacactggttaacgcccttataggctctaaccattttcaagatgaggtccctgattatagtccttctgttcccctccatgtctattagacgatgtgagaagactgaagaggaaacatggggattgaaaatagggttgtgtataattgccaaagatttttatcccgaaagaactgattgcagtgttcatctcccaactgcaagtgaaggattcagggatatacgaaacaccgataaattataaaaaaagcaatgtgtccgctgtttccgttaataatactattttcgtaactggcggattattcataaataactctaatagcacgatcgtggacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatataaatagtttttatgtatagcagtattaccctatagttttattgcttactactaacatggatacagatacagatacagatacagatacagatacagatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcaaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatttaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcgaaatatgtagaaaaggaggagaacacggataaggttagcgctcagaatatctcattcaaatccatgaataaagtatatgggcgatattctgccgtgtttaaagatttctttttgggaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcgagctatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactctctggaagctacgtttatcgatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgtagatcatccgttcatctatgtgattaggcatgttgatggcaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctccctttcttctcttctcccttcctccctcttctccctttcccagaaacaaacttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctattatgcaattaccagatggcattgtaacttcaataggtagtaatttgactattgcgtgtagagtatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcaaactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgagatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgcaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttgattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttctgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtggagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcgtgaaataggaataattagcaccagaatagctatggattattgtggtagagagtgcactattctatgtcgtctactggatgaagatgtgacgtacaaaaaaataaaaccagagattgaaacgtgtcacaacttatcaaaacatatagatagacgaggaaacaatgcgctacattgttacgtcttcaataaatgcgatacagacattaagattgttcggctgttactctctcgcggagtcgagagactttgtagaaacaacgaaggattaactccgctaggagcatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaaaacaaaacgaagctagttgatttattactgagttaccatcccactctagagactatgattgacgcatttaatagagatatacgctatctatatcctgaaccattattcgcctgtatcagatacgccttaatcctagatgatgattttccttctaaagtaaagtatgatatcgccggtcgtcataaggaactaaagcgctatagagtagacattaatagaatgaagaatgtctacatatcaggcgtctccatgtttgatatattatttaaacgaagcaaacgccacaaattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgat

SEQ ID NO: 9 - DNA, 203057 bp, Vaccinia virus
  GLV-1h68
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgcagatctcgagttatgatctacttccttaccgtgcaataaattagaatatattttctacttttacgagaaattaattattgtatttattatttatgggtgaaaaacttactataaaaagcgggtgggtttggaattagtgaaagcttaaaaattgaaattttattttttttttttggaatataaataagctcgaagtcgacagatctaggcctggtaccaggaggaggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgccctgctagcaagcttgctagcggccgctcgagatctgcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggtggtggtgcaaatcaaagaactgctcctcagtggatgttgcctttacttctaggcctgtacggaagtgttacttctgctctaaaagctgctgcagggggggggggggggtgggggggccggttagggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtatcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaaaaaaaaaaaaaaaaaaaaaaaaaaaaaaaaaaaaaaaaaaaaaaaaaaaaaaaaaaaaaaaaagtaccttctgaggcggaaagaaccagccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcggtacccggggatcagcttgcatgcctgcagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacattctagtcgaggaattcatttatagcatagaaaaaaacaaaatgaaattctactatatttttacatacatatattctaaatatgaaagtggtgattgtgactagcgtagcatcgcttctagacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtgacggatccccgatccccgacctgcaggcatgcaagctcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgtcgtagaaacactgaagctaacgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 10 - DNA, 190167 bp, Vaccinia virus
  LIVP genome (reconstituted from GLV-1h68 sequence)
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 11 - DNA, 1340 bp, Homo sapiens
  Erythropoietin
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggagaacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaaaaaaaaaaaa

SEQ ID NO: 12 - protein, 272 aa, Artificial Sequence
  G6-FLAG protein sequence
METDTLLLWVLLLWVPGSTGDEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQGYGNPFTFGQGTKVEIKRDYKDDDDK

SEQ ID NO: 13 - DNA, 366 bp, Homo sapiens
  DNA encoding the human plasminogen kringle 5 domain
atgtacaggatgcaactcctgtcttgcattgcactaagtcttgcacttgtcacgaattcgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattag

SEQ ID NO: 14 - protein, 264 aa, Artificial Sequence
  tTF-RGD protein
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRGRGDSPDYKDDDDK

SEQ ID NO: 15 - DNA, 624 bp, Artificial Sequence
  IL-24 cDNA
atgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctga

SEQ ID NO: 16 - DNA, 1572 bp, Artificial Sequence
  sIL-6R/IL-6 fusion cDNA
atgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctcgaggaggtggaggttctggaggtggaggttctgtcgagccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcac

SEQ ID NO: 17 - DNA, 3717 bp, Artificial Sequence
  pGA4-G6 vector
ctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggctatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgagactacaaggatgacgacgacaagtaattaattaagagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 18 - protein, 5 aa, Artificial Sequence
  FLAG-tag
DDDDK

SEQ ID NO: 19 - DNA, 19 bp, Artificial Sequence
  P-G6-for-b
gtcgacccaccatggagac

SEQ ID NO: 20 - DNA, 35 bp, Artificial Sequence
  P-G6-rev-b
ttaattaattatcgcttaatctcaaccttggtccc

SEQ ID NO: 21 - protein, 272 aa, Artificial Sequence; identical to SEQ ID NO: 12
  GLAF-1

SEQ ID NO: 22 - protein, 264 aa, Artificial Sequence
  GLAF-2
METDTLLLWVLLLWVPGSTGDEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQGYGNPFTFGQGTKVEIKR

SEQ ID NO: 23 - DNA, 5765 bp, Artificial Sequence
  pHA-PSL-hNET-1
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcttttttttttttttttttttggcatataaataagtcgacgccaccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagatgggtaattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 24 - DNA, 1665 bp, Artificial Sequence
  Ruc-GFP
atgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtga

SEQ ID NO: 25 - DNA, 2370 bp, Artificial Sequence
  CBG99-mRFP1
atggtgaagcgtgagaaaaatgtcatctatggccctgagcctctccatcctttggaggatttgactgccggcgaaatgctgtttcgtgctctccgcaagcactctcatttgcctcaagccttggtcgatgtggtcggcgatgaatctttgagctacaaggagttttttgaggcaaccgtcttgctggctcagtccctccacaattgtggctacaagatgaacgacgtcgttagtatctgtgctgaaaacaatacccgtttcttcattccagtcatcgccgcatggtatatcggtatgatcgtggctccagtcaacgagagctacattcccgacgaactgtgtaaagtcatgggtatctctaagccacagattgtcttcaccactaagaatattctgaacaaagtcctggaagtccaaagccgcaccaactttattaagcgtatcatcatcttggacactgtggagaatattcacggttgcgaatctttgcctaatttcatctctcgctattcagacggcaacatcgcaaactttaaaccactccacttcgaccctgtggaacaagttgcagccattctgtgtagcagcggtactactggactcccaaagggagtcatgcagacccatcaaaacatttgcgtgcgtctgatccatgctctcgatccacgcgtgggcactcagctgattcctggtgtcaccgtcttggtctacttgcctttcttccatgctttcggctttagcattactttgggttactttatggtcggtctccgcgtgattatgttccgccgttttgatcaggaggctttcttgaaagccatccaagattatgaagtccgcagtgtcatcaacgtgcctagcgtgatcctgtttttgtctaagagcccactcgtggacaagtacgacttgtcttcactgcgtgaattgtgttgcggtgccgctccactggctaaggaggtcgctgaagtggccgccaaacgcttgaatcttccagggattcgttgtggcttcggcctcaccgaatctaccagcgctaacattcactctctcggggatgagtttaagagcggctctttgggccgtgtcactccactcatggctgctaagatcgctgatcgcgaaactggtaaggctttgggcccgaaccaagtgggcgagctgtgtatcaaaggccctatggtgagcaagggttatgtcaataacgttgaagctaccaaggaggccatcgacgacgacggctggttgcattctggtgattttggatattacgacgaagatgagcatttttacgtcgtggatcgttacaaggagctgatcaaatacaagggtagccaggttgctccagctgagttggaggagattctgttgaaaaatccatgcattcgcgatgtcgctgtggtcggcattcctgatctggaggccggcgaactgccttctgctttcgttgtcaagcagcctggtaaagaaattaccgccaaagaagtgtatgattacctggctgaacgtgtgagccatactaagtacttgcgtggcggcgtgcgttttgttgactccatccctcgtaacgtaacaggcaaaattacccgcaaggagctgttgaaacaattgttggagaaggccggcggtggttccggagccacgaacttctctctgttaaagcaagcaggagacgtggaagaaaaccccggtcccatggcctcctccgaggacgtcatcaaggagttcatgcgcttcaaggtgcgcatggagggctccgtgaacggccacgagttcgagatcgagggagagggcgagggccgcccctacgagggcacccagaccgccaagctgaaggtgaccaagggcggccccctgcccttcgcctgggacatcctgtcccctcagttccagtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctccaccgagcggatgtaccccgaggacggcgccctgaagggcgagatcaagatgaggctgaagctgaaggacggcggccactacgacgccgaggtcaagaccacctacatggccaagaagcccgtgcagctgcccggcgcctacaagaccgacatcaagctggacatcacctcccacaacgaggactacaccatcgtggaacagtacgagcgcgccgagggccgccactccaccggcgcctaa

SEQ ID NO: 26 - DNA, 212 bp, Artificial Sequence
  Vibrio fischeri ES114 LuxR gene
cattttttgttcacctagcttattgttatgttttttgcgtgttatataacaccaatttggaggtttggtgatatcgcttccaattaattcgatctgggtcacatttatgcatcttggtggaaacgtggtgttaacattgcagctgtaggatggtacaggtttccgtaatgcatcagtttgttatgatcatgtaaaataagagaggttgcatg

SEQ ID NO: 27 - protein, 355 aa, Artificial Sequence
  Luciferase alpha chain LuxA
MKFGNIYFSYQPPGETHKQIMDRFVRLGSVSEELGFDTYWTLEHHFTEFGLTGSLFVSAANLLGRTKTLKVGTMGVVVPTAHPVRQAEDVLLLDQLSKGRFNFGVVRGLYHKDFRVFGVNMEESREITQDFHQMIMKSFDEGAIHSNSKHIDFPDVNVYPTKYSKEIRTCMTAESASTTEWLARQGMPMVLSWIIGTNEKKTQMELYNEIATEHGHDISKIDHCLTYICSVHEDGDRAREVCRKFLISFYDSYVNATNIFNDSDQTRGYDYHKGQWRDFVLQGHTDTNRRVDYSHGLNPVGTPAECLEIIQRDIDATGITNVTCGFEANGTEEEIIASMELFMTKVAPFLKEPQK

SEQ ID NO: 28 - protein, 326 aa, Artificial Sequence
  Luciferase beta chain LuxB
MNFGLFFLNFQKNGITSEETLNCMVDTVTLIDSDDYHFDSAFVCEHHFSRNGIVGAPITAAGFLLGLTNRLRIGSLNQVITTHHPVRVAEEVGVLDQMSEGRFVLGFSDCENDFEMEFFKRHIPSRQQQFEACYDVINEALTTGYCHPQNDFYNFPKISVHPHCYSENGPKQYVLATSKEVVKWAAKKALSLIFKWDDNLEVKERYAVLYNKTAQQYGVDISDVDHQLTVIVNLNTDKNTAQEEVREYLKGYITETYPHISRDEKINCIIEENAVGTHNDYYESTKLAVEKTGAKNILLSFESMNDINDVKDIIDMLNQKIEKNLP

SEQ ID NO: 29 - protein, 479 aa, Artificial Sequence
  Acyl-CoA reductase LuxC
MIKCIPMIIKGVVQDFDNNACKEINLDSGNKIKLSLLTEDSVLRSLNSKEKVDLNLNQIVNFLYTVGQRWKNEEYNRRRTYIRELKKYLGYSDEMARLEANWIAMLLCSKSALYDIVNYDLGSIHVLDEWLPRGDCYVKAQAKGVSIHLLAGNVPLSGVTSILRAILTKNECIIKTSSSDPFTATALASSFIDVNAEHPITKSMSVMYWPHNEDMTLPQRIMNHADIVIAWGGEEAIKWAAKHSPPHADVLKFGPKKSLSIIEEPEDMEEAAMGVAHDICFYDQQACFSTQDVYYIGEHLPLFLSELEKQLDRYAKILPKGLKNFDEKAAFSLTEREGIFAGYDVKKGDNQAWLMIISPTNSSGNQPLSRSVYIHQVSDINEVLPFVNKNSTQTVSIYPWEASLKYRDKLAMSGAERIVESGMNNIFRVGGAHDSLSPLQYLVRFTSHERPFHYTTKDVAVEIEQTRYLEEDKFLVFVP

SEQ ID NO: 30 - protein, 307 aa, Artificial Sequence
  Acyl transferase LuxD
MKDESSFFTIDHIIELENGQSIRVWETPPKSDTHKKNSTIVIAAGFARRMDHFAGLAEYLSSNGFRVIRYDSLHHVGLSSGQIDEFSMSIGKHSLLIVVGWLRAKGIQNLGIIAASLSARIAYEVINDIDASFLITAVGVVNLQDTLEKALKYDYLRLPIDELPDDLDFEGHNLGSKVFVTDCLKNEWDTLGSTFKAVQGLNIPFIAFTANGDSWVNQSDVEKMIDNIDTTQCKLYSLIGSSHDLGENLVVLRNFYESVTRAAVALDKGSLDLDIEIVEPGFEDLTSTTVKERRLRNKIENELLELA

SEQ ID NO: 31 - protein, 376 aa, Artificial Sequence
  Long-chain-fatty-acid ligase LuxE
MTNHIEYKKNQIIASSEIDDLIFMSAPQEWSLEEQKEIQDKLVREAFHFHYNRNEKYRNYCISQHINENLHSIDEIPVFPTSIFKHMKFHTVSMGDIENWHTSSGTQGIKSCIARDRLSIERLLGSVNFGMKYVGNWFEHQMELVNLGPDRFSASNVWFKYVMSLVELLYPTVFTVNNDKIDFEETVNHLYRINNSNKDICLIGPPFFVSLLCQYMKENNIEFKGENRLHVITGGGWKSNENSSLNRQDFNQLIMDTFQLDNVNQIRDTFNQVELNTCFFEDEFQRKHVPPWVYARALDPETLKPVADGELGLLSYMDASSTAYPAFIVTDDIGIVREIREPDPYPGVTVEIVRRLNTRAQKGCALSMASFIQSTI

SEQ ID NO: 32 - DNA, 2858 bp, Homo sapiens
  hNET transcript variant 1
agcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagatgaaaacgagacaagggagaaggagagctaccaactcttgccagatatcctgctgaacagaaatccctgaagctgccttaattctcaaaaggagttaccgctcagctgggagccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtagtgtggcggaaaaagcacagcatatagttttacagacttgggtctgcagctgactagctgggtggcctggggatagtggcttcatcttttggggcttcaagattctttgtctttaaaatcaggggttatatcagatcatcaaagttcccattccattaaagaaaaccctgcatgtatccataatgatgctctcctgttaaatttacaatgaaggaaacacatcacttaactgtaagaatttcccaaaatgaactgatgaccagtgatctctctatcagagaaatgtcagatttctagcctccagaactttgatttttctggacattcaatagttcctctttctcagatatttttcaactgatgccagaaacacttggtatttgtttttaatccaacccttttgttttgaggctttggagggtaacacattttcataccctgtgagtcccaggatccacagctctgctgtggtcttagaagccactgaaacattggtgaatgtgaagtcacttttggggtgcctgccctcatccctctgtctctctgcttccgtgtaaataaagactgtttcaattgtgtcctctctgtgtcatggactgttccaatgtcatgcagatttctgtgtctgatatggattttaaaagttgttctctttgtggaatataagtgtacagaataataaataatgtttcctgggctgtgta

SEQ ID NO: 33 - DNA, 3887 bp, Homo sapiens
  hNET transcript variant 2
agagctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 34 - DNA, 3551 bp, Homo sapiens
  hNET transcript variant 3
gtcagaagtctccaactcttgagttccggcgtgccccaacctctgtttccaaatttttccagcggacgcgcgcccttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 35 - DNA, 3157 bp, Homo sapiens
  hNET transcript variant 4
aggttgtgtgctccttatgagaatctaactaacgcctgatgacctgaggtggaacggtttcatcttgaaactacccccaccccaaaatctgtggaaaaattgtcttccatgcgacaggtcactggtgctgaaaaggttggggaccgctgttctgcaggaaacgagagacagagggaatgggagtgcagtggtggagccacacccaaggagaggtggctgtggggctgggcctgggagactcctaccttaccccctgtccctgcccaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 36 - DNA, 3594 bp, Homo sapiens
  hNIS member 5
gctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtattagacgctgcagccctgacggctccccccaaataaggctgggtttttctctctctcttttttttttttttttttttttgagacagggtcatgctctgtcacccaggctggagtgcagtggtgtgatctcggctcactgcaacctctgcctcccaggctcaagtgattctcctgcctcagcctcttgagtagctgggattgtaggtgcccaccaccatgcccagccaactttttgtatttttagtagagacagggtttcaccatgttggtcaggctggtctcgaactcctgacctcaagtgatccacctgcctcggcctcccaaagtgctgggttacaggcgtaagctaccatgcccagcctaccgtttttctcaatctataatagaaagccaccacgcccaggtaatttttgtaattttgtatttttgtagagacggggttttgccatgttggccaggctggtctcaaactcctgatctcaggtgatcctcctgccttggcctcccaaagggctgggattacaggggtgagccaccgcgccccacctctttcttattttcttcctgggattggggaggggatgattcagaccccacatggcctccaaccttggcccacacacctgccatggctcccatcatcctgagcatgctagcgtcccctcctcacctgacaatggaggctctcgaattgggttgtgtccccccaaaatttatgtctacccagaacctcagaacatgagcttacttggaaatagggtctttgcaggtgtaactggttaaattaaaagaggtattactggaggaggatggatgaatccagtgactggttcctcatatgaagtagagaagagatgcagagaaacacatggggaagatgccacgtgaagacagaggcagtggttggatcaatgcatctacgagtcggagaacccaaggattgccagcaacaaccagaaatcaggaggggggcatgagatgcattatttcttagagcctttagagggaacatggccctactgacaccttgatgtcagacttctggctgctagaactgtcagagaataaatttctgttgtttgatgccaaaaaaaaaaaaaaaaaaa

SEQ ID NO: 37 - DNA, 2068 bp, Homo sapiens
  hNIS member 5 cDNA clone complete cds
agcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtactcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccat

SEQ ID NO: 38 - DNA, 2068 bp, Homo sapiens; identical to SEQ ID NO: 37
  hNIS member 5 cDNA clone complete cds

SEQ ID NO: 39 - DNA, 3353 bp, Homo sapiens
  Cyp11B1 transcript variant 1
cattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctggggtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggtgttgggtcctctgcttcctgtgctgtcccctggggaaggtcccgaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcccgtgcagggagaggaagcacccagtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagacctcttttataaggacgccagttccattcaagagggcactgcctgcattcccttcccccctcaaaggcccggccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctatgaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaaaaaaaaaaaaaaaaaa

SEQ ID NO: 40 - DNA, 3551 bp, Homo sapiens
  Cyp11B1 transcript variant 1
cattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggtgttgggtcctctgcttcctgtgctgtcccctggggaaggtcccgaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcccgtgcagggagaggaagcacccagtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagacctcttttataaggacgccagttccattcaagagggcactgcctgcattcccttcccccctcaaaggcccggccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctatgaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaaaaaaaaaaaaaaaaaa

SEQ ID NO: 41 - DNA, 2936 bp, Homo sapiens
  Cyp11B2
ggaatggcactcagggcaaaggcagaggtgtgcgtggcagcgccctggctgtccctgcaaagggcacgggcactgggcactagagccgctcgggcccctaggacggtgctgccgtttgaagccatgccccagcatccaggcaacaggtggctgaggctgctgcagatctggagggagcagggttatgagcacctgcacctggagatgcaccagaccttccaggagctggggcccattttcaggtacaacttgggaggaccacgcatggtgtgtgtgatgctgccggaggatgtggagaagctgcaacaggtggacagcctgcatccctgcaggatgatcctggagccctgggtggcctacagacaacatcgtgggcacaaatgtggcgtgttcttgttgaatgggcctgaatggcgcttcaaccgattgcggctgaacccagatgtgctgtcgcccaaggccgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttagctctttttggagagcggctgggcctggttggccacagccccagttctgccagcctgaacttcctccatgccctggaggtcatgttcaaatccaccgtccagctcatgttcatgcccaggagcctgtctcgctggatcagccccaaggtgtggaaggagcactttgaggcctgggactgcatcttccagtacggtgacaactgtatccagaaaatctaccaggaactggccttcaaccgccctcaacactacacaggcatcgtggcggagctcctgttgaaggcggaactgtcactagaagccatcaaggccaactctatggaactcactgcagggagcgtggacacgacagcgtttcccttgctgatgacgctctttgagctggctcggaaccccgacgtgcagcagatcctgcgccaggagagcctggccgccgcagccagcatcagtgaacatccccagaaggcaaccaccgagctgcccttgctgcgggcggccctcaaggagaccttgcggctctaccctgtgggtctgtttttggagcgagtggtgagctcagacttggtgcttcagaactaccacatcccagctgggacattggtacaggttttcctctactcgctgggtcgcaatgccgccttgttcccgaggcctgagcggtataatccccagcgctggctagacatcaggggctccggcaggaacttccaccacgtgccctttggctttggcatgcgccagtgcctcgggcggcgcctggcagaggcagagatgctgctgctgctgcaccacgtgctgaagcacttcctggtggagacactaactcaagaggacataaagatggtctacagcttcatattgaggcctggcacgtcccccctcctcactttcagagcgattaactagtcttgcatctgcacccagggtcccagcctggccaccagcttccctctgcctgaccccaggccacctgtcttctctcccacgtgcacagcttcctgagtcacccctctgtccagccagctcctgcacaaatggaactccccagggcctccaggactggggcttgccaggcttgtcaaatagcaaggccagggcacagctggagacgatcttgctggcagggcctggccttgtccccagctccacctggccccttctccagcaagcagtgccctctggacagcttgactctactcccagcgctggctccaggctcctcatgaggccatgcaagggtgctgtgattttgtcccttgccttcctgcctagtctcacatgtccctgtccctctcgccctggccagggcctctgtgcagacagtgtcagagtcattaagcgggatcccagcatctcagagtccagtcaagttccctcctgcagcctgaccccaggcagctcgagcatgccctgagctctctgaaagttgtcaccctggaatacgatcctgcagggtagactaaaaaggcccctgtggtcacttatcctgacacattttcaagtgatacaactgagtctcgaggggcgtgtgttccccagctgatcatgtcagcctcatgccccaggcctcgtctttcatggaccaggtcttgttcaagcagcgagtgttgggtcctctgcttcctgagctgtcccctggagaaggtcccgaggatgctgtcaggagatggaagagtcatgtggggtgggaacctggggtgtggttccagaaatgtttttggcaacaggagagacaggattgggccaacaaggactcagatgagttttattgactcattcctctggttgatacggagccatgtcatgtgccacgacctggggtgggcacagggaggctgcagttccctacgtgaacctgccttgggcctcatctgctcctagcccagcagagagagttgacccctcctgaactggccactccccagtgctcctgtgcagggataggaagtgccccagggtgagaacgtgcccagccacatcatctttatctcctgggattttcattagggcaaagatctcagcagccagctcctggtagctgatgaggatcagagcgtttgttcccccatgaaaggggaaatacttaggtaatcattccaggtgtgttcagtagttccaggactcagggactcaggccagtcaccctgtgaccgcaggttgctttcccaccctgggcaatgcagtgcagcatgggaaaggaataagggggcaacaaggtgcacagacctcagagatggcttccttgtttatggggctctcacagatacccatccaactcctctagtcagcactagatcatgggatcctaaaataaaccttggaaaaat

SEQ ID NO: 42 - DNA, 3208 bp, Homo sapiens
  Cyp51A1 transcript variant 1
gtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaataca

SEQ ID NO: 43 - DNA, 2934 bp, Homo sapiens
  Cyp51A1 transcript variant 2
acgccgtgtcccggcaccccgcacccgggcacacaaaaaacgggtcgcccgcgattctcagggattgatcgcctcttcagaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaataca

SEQ ID NO: 44 - DNA, 5100 bp, Homo sapiens
  Human transferrin receptor
acgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaa

SEQ ID NO: 45 - DNA, 5241 bp, Homo sapiens
  Human transferrin receptor
agagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaa

SEQ ID NO: 46 - DNA, 4920 bp, Mus musculus
  Mouse transferrin receptor
gtgcggaaggaagtgacgtagatccagagggccggccggggggtggggccgagctataagctttgggtgggaggcagcgctgccttcagaaggcgtgcggagcgcgggctgctgcattgcggactgtagaggcgcttcctagtactcccttgtagcagctgagaatgatggatcaagccagatcagcattctctaacttgtttggtggggaaccattgtcatacacccggtttagccttgctcggcaagtagatggagataacagtcatgtggagatgaaactggctgcagatgaagaagaaaatgccgacaataacatgaaggctagtgtcagaaaacccaagaggtttaatggaagactctgctttgcagctattgcactagtcattttcttcttgattggattcatgagtggctacctgggctattgtaagcgtgtagaacaaaaagaggagtgtgtgaaactggctgaaacggaggagacagacaagtcagaaaccatggaaacagaggatgttcctacatcatctcgcttatattgggcagacctcaaaacactgttgtcagagaagttgaactccatagagtttgctgacaccatcaagcagctgagccagaatacatacactcctcgtgaggctggatctcaaaaagatgaaagtcttgcctattatattgaaaatcagttccatgaatttaaattcagcaaagtctggcgagatgaacactatgtgaagattcaagtgaaaagcagcattggtcaaaacatggtgaccatagtgcagtcaaatggtaacttagacccagtggagtctcccgagggttatgtggcattcagtaaacctacagaagtttctggtaaactggtccatgctaattttggcactaaaaaggactttgaagaactaagttattctgtgaatggatctttagtgattgttagagcaggggaaattacttttgcagaaaaggttgcaaatgcccaaagctttaatgcaattggtgtcctcatatacatggacaagaataaattccccgttgttgaggcagaccttgcactctttggacatgctcatctaggaactggtgatccatacacacctggctttccttctttcaatcatactcagtttccgccatctcagtcatcagggttgcctaatatacctgtgcaaacaatctcaagagctgctgcagaaaagctatttggaaaaatggaaggaagctgtcctgctagatggaacatagattcttcatgtaagctggaactttcacagaatcaaaatgtgaagctcattgtgaaaaacgtactgaaagaaagaagaatacttaacatctttggagttattaaaggttatgaggaaccagaccgttatgttgtagtaggagcccagagagacgctttgggtgctggtgttgcggcgaagtccagtgtgggaacaggtcttctgttgaaacttgcccaagtattctcagatatgatttcaaaagatggatttagacccagcagaagtataatctttgccagctggactgcaggcgactttggagctgttggtgccactgagtggttggagggatacctttcatctttgcatttaaaagctttcacttatattaatttggataaagttgtccttggtactagtaacttcaaagtttctgccagccccttattatatacacttatgggaaagataatgcaagatgtaaagcatccagttgatggaaaatctctatatagagacagcaattggattagcaaagttgagaaactttcctttgacaatgctgcatatcctttccttgcatattctggaatcccagcagtttctttttgtttttgtgaggatgcagactatccttatttgggcactagattggatacctatgaggcattgactcagaaagttcctcagctcaaccaaatggttcgtacagcagcggaagtggctggtcagctcattattaaacttacccatgacgttgaattgaacctggactatgagatgtataacagcaaactactgtcatttatgaaggatctgaaccagttcaaaacagatatcagggatatgggtctaagtctacagtggctgtattccgctcgtggagactacttccgtgctacttctagactaacaactgattttcataatgctgagaaaacaaacagatttgtcatgagggaaatcaatgatcgtattatgaaagtggagtatcacttcctgtcgccctatgtatctccaagagagtctcctttccgacatatcttctggggctctggctctcacactctctcagctttagtggagaacttgaagcttcgtcaaaaaaatattactgcttttaatgaaaccctcttcagaaaccagttggccctggctacttggactattcagggagtcgcaaatgccctctctggtgacatttggaatattgacaatgagttttaaatgtaacatgcataattaaataagagcagggtagtctgtttctagacttgtgttggttgtgctaaattttcattagagctctaaaatctaatgttaaaattctacccaatcatctaatgtcttaggcagcagcttttagtgcggggttggacctacacttcaagtacaatggataacactttccatgtttgtgatatcttctcagattatctttaaaatttttgagtcctttgtaataacttcctctttgcttcatggtcatgaaaatgtcagaaccagttgtaagaacaatgctatatgtcctgagggcattaactagtgtcttttgaggtaggagaaagagtgtgcttgtggagggtcaacgtggtagttgggtagttggagattgccccgtctccatctgatcttccattgagctgtatgcccttaaggatgtagctggtttgcatttccctaaattagacagtaactttcagaagagatggaacttgttttcttgccagcaaggttgaaaataggtccttagctggaccaatttgtctgtttacaggaataagtaaggccttactggttaaccttggtgttctttatgatgagaccagaagccaaagacctcaagttttctctcctcttggcatctgccctatagtctttagttctttgtttttattttgtttttctttttttcccaacattttctgaaaaagaacaagttttagactcaatttgtcagacttgaaaagaacacactgccaagttttggccaaagtgttagtcttcaggaaagctttctatcattttggcactgagatatttattgtttatttatcagtgacagagttcactataaatagtgttgttttttttttatatatagaagataattatcggaagcagtgccttccataattatgacagttatactgtcgttttcttttaataaaagcagcatctgctaatgagacccacagatactggaagttttgcacttatggtcagcacttgcaactttaggaaggaagaatgccacaatccaaataatatgagctagaagaggattgggttaaataagagattcctaattgagttggggaaaaaaatgatagttttcctaagtgcagtgagttgtggccaagttaaatgtcatttaaaggctatggtagtacttacatctacaaaattttacagctcaatttattcaagatgtaactcaaaatcaattttgcaaaatttccagtacctttgtcacaaacttaactcacattatcgggagcagtgtcttccataatgcataaagaacaaggtagtttttgcctaccacagtgtctatatcggagacagtgatctccatatgttacactaagggtgtacgtaattatcgggaacagtgtttcccataattttcttcatgcaatgacatcttcagagcttgaagatcgttagtatctaacatgaattcctaacttcctgtagctccttagttttagttgcaaaaaacatttgtggtcattgagcatttggtgggtaaaatcaactgctgtaaaatcattacttccaagatccttttttaaaatgtgggtattttgttatctctggtttatggaataaaagcatacgtttataatgtttgctggtgacaaaggaatttaactatctccctttatttgcatgttacatgttatttcctaaatgtagttcttagaagtttgaattcatttttggtttttgggagggtagaaagtagagaataatgggtgttgggaagacaaagcttgcaaaaggatctttatgtacctgctcatcactatggtggctatgaattatgtaggtaatgagcaagatcacattaacaaagactagttaaccatcattacgcatctaatcagttttgccatggggtcagttcaaagctgccacctgagaatgtcactaggctctcagggtcttggcaccactcgcccaagttatatccaccagattattttgagcctcactgagttgttttgctactcagtcccttcagtcttcacagtgtttctcttgtaccagtatgagtatcaccgtgcataatgggattccaagtcttgaatgaaggcatgcattttacatagacgtctctgtgaaataacctttgttgtaagtggtgtttccagtcaaagcagtaagttggtaaggtttagtcttgggtgaaatgtggatctgagtaataagtagcttctgctacttatcaggttattgttggttaaaatgtagattttgaagataaaaatagatcttttgtcatgactcactgctagaatttgcatgacctttactgtgttagcttttgaatgccttttggtttggacttgccaacctatactgtctttgctgaaatgcccttataaatgtatacagctggtatgtaacaatgtgaagattccttacctgacttaataaaatacttcgataatactgaaaaaaa

SEQ ID NO: 47 - DNA, 889 bp, Homo sapiens
  Human ferritin light chain (FTL)
gcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcaaaaaaaaaaaaaaaaaaa

SEQ ID NO: 48 - DNA, 1245 bp, Homo sapiens
  Human ferritin heavy chain
ataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaaaaaaaaaaaaaaaaaa

SEQ ID NO: 49 - DNA, 498 bp, Escherichia coli
  DNA encoding E. coli ferritin (ftn)
atgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaa

SEQ ID NO: 50 - protein, 165 aa, Escherichia coli
  E. coli strain K12
MLKPEMIEKLNEQMNLELYSSLLYQQMSAWCSYHTFEGAAAFLRRHAQEEMTHMQRLFDYLTDTGNLPRINTVESPFAEYSSLDELFQETYKHEQLITQKINELAHAAMTNQDYPTFNFLQWYVSEQHEEEKLFKSIIDKLSLAGKSGEGLYFIDKELSTLDTQN

SEQ ID NO: 51 - protein, 166 aa, Staphylococcus aureus
  S. aureus strain MRSA252
MLSKNLLEALNDQMNHEYFAAHAYMAMAAYCDKESYEGFANFFIQQAKEERFHGQKIYNYINDRGAHAEFRAVSAPKIDFSSILETFKDSLSQEQEVTRRFYNLSEIARQDKDYATISFLNWFLDEQVEEEAMFETHINYLTRIGDDSNALYLYEKELGTRTFDEE

SEQ ID NO: 52 - protein, 166 aa, Staphylococcus aureus
  S. aureus strain NCTC 8325
MLSKNLLEALNDQMNHEYFAAHAYMAMAAYCDKESYEGFANFFIQQAKEERFHGQKIYNYINDRGAHAEFRAVSAPKIDFSSILETFKDSLSQEQEVTRRFYNLSEIARQDKDYATISFLNWFLDEQVEEESMFETHINYLTRIGDDSNALYLYEKELGARTFDEE

SEQ ID NO: 53 - protein, 167 aa, Helicobacter pylori
  H. pylori B8
MLSKDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 54 - DNA, 4164 bp, Homo sapiens
  SLC11A2 transcript variant 4
cgaccaatcgcggggaggggagggcgttagccagcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 55 - DNA, 4156 bp, Homo sapiens
  SLC11A2 transcript variant 1
atatatagaggcaggagctggcattgggaaagtcaaactagttctgcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 56 - DNA, 3795 bp, Homo sapiens
  SLC11A2 transcript variant 2
cgaccaatcgcggggaggggagggcgttagccagcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccacactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggtgggaatgcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccag

SEQ ID NO: 57 - DNA, 3790 bp, Homo sapiens
  SLC11A2 transcript variant 3
cgaccaatcgcggggaggggagggcgttagccagcgtggcgctggctcccggaatatggagccctgggcgcgggggcggcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccacactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggtgggaatgcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccag

SEQ ID NO: 58 - DNA, 4159 bp, Homo sapiens
  SLC11A2 transcript variant 5
cgaccaatcgcggggaggggagggcgttagccagcgtggcgctggctcccggaatatggagccctgggcgcgggggcggcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 59 - DNA, 4424 bp, Homo sapiens
  SLC11A2 transcript variant 6
agagtccaggactgatggagtcgcgccattcagagaaagacccaaagatgggggcagggagggaacgccggaggtcgcgggggtctcgccccttccccgccgcggcctaggacacatggcccagctcccagctgcaccggatggcgcgcccggcctgtgtcggggtgcgctgacctgcttcgacgcctcgaaagaggccgacgggcacagggcaaggtctttcgtggcctcttcgtcggcgccgcagggggccgggctgctctccggggcctcccgccgccccgcttcaacaaaagactcattataacctaaccgacttcagggagcgccttctgtgtgaatagcctgcatacgcggctcagtaattaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 60 - DNA, 4139 bp, Homo sapiens
  SLC11A2 transcript variant 7
actttactgcaagccttagtcagagtacaaagggttcctgcttggtggttttgctgcagcttcagagtttagcctgaactgtggcaggattttgtaacttgcacattttttgagaagtctgatggaggtataatgtccacggtcgattatttgaacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 61 - DNA, 781 bp, Homo sapiens
  Granulocyte-macrophage CSF2
acacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttcta

SEQ ID NO: 62 - DNA, 760 bp, Homo sapiens
  Chemokine ligand 2 CCL2
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaa

SEQ ID NO: 63 - DNA, 1976 bp, Homo sapiens
  IL-24 transcript variant 1
gcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 64 - DNA, 1820 bp, Homo sapiens
  IL-24 transcript variant 4
gcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcgcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 65 - DNA, 1621 bp, Homo sapiens
  IL-24 transcript variant 5
gcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcaagctcaggataacatcacgagtgcccggctgctgcagcaggaggttctgcagaacgtctcgcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 66 - DNA, 1227 bp, Homo sapiens
  Chemokine ligand 10 CXCL10
ctttgcagataaatatggcacactagccccacgttttctgagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtagaagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaaataaaaatgaggtactctcctggaaatattaagaaagactatctaaatgttgaaagatcaaaaggttaataaagtaattataactaagaaaaaaaaaaaa

SEQ ID NO: 67 - DNA, 2923 bp, Homo sapiens
  Sequestosome 1 transcript variant 1
cctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaaaaaaaaaaaaaaaaaaaaa

SEQ ID NO: 68 - DNA, 2848 bp, Homo sapiens
  Sequestosome 1 transcript variant 3
ggatttaaaggggccgcagcaccgccgtcgccggcgccgcgagggggtggggtgggggccggcggccgggatcccgatcggctcccgcagccccgcgtgggctcgtgcgagtcggcctcagtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaaaaaaaaaaaaaaaa

SEQ ID NO: 69 - DNA, 2931 bp, Homo sapiens
  Sequestosome 1 transcript variant 2
gcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaaaaaaaaaaaaaaaa

SEQ ID NO: 70 - DNA, 4326 bp, Homo sapiens
  STAT1 transcript variant alpha
gctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtcagttctttttgccctttgggaattcggcatggtttcattttactgcactagccaagagactttacttttaagaagtattaaaattctaaaattcaaaaaaaaaaaaaaaaaa

SEQ ID NO: 71 - DNA, 2798 bp, Homo sapiens
  STAT1 transcript variant beta
gctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaagccaaaaaccaaatttgtatttaaggtatataaattttcccaaaactgataccctttgaaaaagtataaataaaatgagcaaaagttgat

SEQ ID NO: 72 - DNA, 1552 bp, Homo sapiens
  SERPINF1
ggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaaaaaaaaaaaaaaaaaaaaa

SEQ ID NO: 73 - DNA, 794 bp, Artificial Sequence
  Anti-VEGF single chain antibody
atggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgaga

SEQ ID NO: 74 - DNA, 1031 bp, Homo sapiens
  NM23A expressed in NME1 transcript variant 1
gcagaagcgttccgtgcgtgcaagtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 75 - DNA, 811 bp, Homo sapiens
  NM23A expressed in NME1 transcript variant 2
gcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 76 - DNA, 4815 bp, Homo sapiens
  Cadherin 1 type 1
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 77 - DNA, 967 bp, Artificial Sequence
  Relaxin 1
ggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgccacttt

SEQ ID NO: 78 - DNA, 2387 bp, Homo sapiens
  MMP9
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 79 - DNA, 7088 bp, Homo sapiens
  Neogenin 1 transcript variant 1
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 80 - DNA, 6929 bp, Homo sapiens
  Neogenin 1 transcript variant 2
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 81 - DNA, 7055 bp, Homo sapiens
  Neogenin 1 transcript variant 3
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 82 - DNA, 2573 bp, Homo sapiens
  PDX1
gggtggcgccgggagtgggaacgccacacagtgccaaatccccggctccagctcccgactcccggctcccggctcccggctcccggtgcccaatcccgggccgcagccatgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatgagaggcaggagctgctcctggctgaggggcttcaaccactcgccgaggaggagcagagggcctaggaggaccccgggcgtggaccacccgccctggcagttgaatggggcggcaattgcggggcccaccttagaccgaaggggaaaacccgctctctcaggcgcatgtgccagttggggccccgcgggtagatgccggcaggccttccggaagaaaaagagccattggtttttgtagtattggggccctcttttagtgatactggattggcgttgtttgtggctgttgcgcacatccctgccctcctacagcactccaccttgggacctgtttagagaagccggctcttcaaagacaatggaaactgtaccatacacattggaaggctccctaacacacacagcggggaagctgggccgagtaccttaatctgccataaagccattcttactcgggcgacccctttaagtttagaaataattgaaaggaaatgtttgagttttcaaagatcccgtgaaattgatgccagtggaatacagtgagtcctcctcttcctcctcctcctcttccccctccccttcctcctcctcctcttcttttccctcctcttcctcttcctcctgctctcctttcctccccctcctcttttccctcctcttcctcttcctcctgctctcctttcctccccctcctctttctcctcctcctcctcttcttccccctcctctccctcctcctcttcttccccctcctctccctcctcctcttcttctccctcctcttcctcttcctcctcttccacgtgctctcctttcctccccctcctcttgctccccttcttccccgtcctcttcctcctcctcctcttcttctccctcctcttcctcctcctctttcttcctgacctctttctttctcctcctcctccttctacctccccttctcatccctcctcttcctcttctctagctgcacacttcactactgcacatcttataacttgcacccctttcttctgaggaagagaacatcttgcaaggcagggcgagcagcggcagggctggcttaggagcagtgcaagagtccctgtgctccagttccacactgctggcagggaaggcaaggggggacgggcctggatctgggggtgagggagaaagatggacccctgggtgaccactaaaccaaagatattcggaactttctatttaggatgtggacgtaattcctgttccgaggtagaggctgtgctgaagacaagcacagtggcctggtgcgccttggaaaccaacaactattcacgagccagtatgaccttcacatctttagaaattatgaaaacgtatgtgattggagggtttggaaaaccagttatcttatttaacattttaaaaattacctaacagttatttacaaacaggtctgtgcatcccaggtctgtcttcttttcaaggtctgggccttgtgctcgggttatgtttgtgggaaatgcttaataaatactgataatatgggaagagatgaaaactgattctcctcactttgtttcaaacctttctggcagtgggatgattcgaattcacttttaaaattaaattagcgtgttttgttttg

SEQ ID NO: 83 - DNA, 2373 bp, Homo sapiens
  MAFA
gcgcggccgggcgcgggccccgggcgatggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccatcaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtaggcgccggaccccgagcccgcgccgccgtcgccggggacaagttcgcgcaggcctctcggggcctcggctcggactccgcggtacaggacgtggacaccaggcccggcccggccgtgctggccccggtgccaagtctgcgggcgcggggctggaggccccttcgctcccggtccccgttcgcgcgcgtcggcccgggtcgccgtcctgaggttgagcggagaacggtgatttctaaggaaacttgagccaggtctaacttctttccaagcgtccgcttgtacatacgttgaacgtggttctccgttcccaccttcgccctgccagcctagagggaccgcgctgccgtcccttcccgggtggcccctgcctgcccccgccctccttcgttctcttctcagcctccctttccttgccttttttaacttcccctccccgttttaaaatcggtcttattttcgaagtatttataattattatgcttggtgattagaaaagaaaaccttggaggaagccccttctttccccagccggggtccgccctcagtcgcgagtcacagcatgagtcgctcgccaggaggggcccggcccctgcctgccccctccccgcttgcccccgaccctgctaccggcgttccttggaggtcgaagccagggacgtcacccgtgctgtgtccaggcctgctgtcctactatgctcaaccgggggtggggggaggggggtgagtcctgtgctcagtcgggtgggggctggcccggatcccgagctgctgtctctctatgcaccagaacatatctgtaactcctggggaaatacatcttgttttaaccttcaagagaagtgaaagaaaaaagtaatgcacagtatttctagcagaaaatttttttttttaagaggaggcttgggccagagccttctggcatggggcgggtggagaaagtgtttttattttaatttaaattgtgtttcgttttgtttgtggaatctttctttaatgcttcgtcgctctttggactagccgggagagagggcgaggaggcgggtgctccaggccctgtaggctgggccaggcgcctgggggatctgcccgttttcggaggccctcaggggccatcagtgggattccagccgctccacacccctcccctgagcactcggagtggaaggcgcgccgactcgttgaaagttttgttgtgtagttggttttcgttgagttcttttttcatttgctacgaaactgagaaaaagaaaaaaatacacaaaataaatctgttcagatccaagtca

SEQ ID NO: 84 - protein, 206 aa, Homo sapiens
  Flavin reductase
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 85 - protein, 244 aa, Artificial Sequence
  mNeptune monomeric far-red fluorescent protein
MVSKGEELIKENMHMKLYMEGTVNNHHFKCTSEGEGKPYEGTQTGRIKVVEGGPLPFAFDILATCFMYGSKTFINHTQGIPDFFKQSFPEGFTWERVTTYEDGGVLTATQDTSLQDGCLIYNVKIRGVNFPSNGPVMQKKTLGWEASTETLYPADGGLEGRCDMALKLVGGGHLICNLKTTYRSKKPAKNLKMPGVYFVDRRLERIKEADNETYVEQHEVAVARYCDLPSKLGHKLNGMDELYK

SEQ ID NO: 86 - protein, 186 aa, Renilla muelleri
  coelenterazine-binding protein 1
MPEITESERAYHLRKMKTRMQRVDVTGDGFISREDYELIAVRIAKIAKLSAEKAEETRQEFLRVADQLGLAPGVRISVEEAAVNATDSLLKMKGEEKAMAVIQSLIMYDCIDTDKDGYVSLPEFKAFLQAVGPDLTDDKAITCFNTLDFNKNGQISRDEFLVTVNDFLFGLEETALANAFYGDLVD

SEQ ID NO: 87 - protein, 360 aa, Bombyx mori
  Allostatin A receptor
MESTEDEFYTICLNLTAEDPSFGNCNYTTDFENGELLEKVVSRVVPIFFGFIGIVGLVGNALVVLVVAANPGMRSTTNLLIINLAVADLLFVIFCVPFTATDYVMPRWPFGDWWCKVVQYFIVVTAHASVYTLVLMSLDRFMAVVHPIASMSIRTEKNALLAIACIWVVILTTAIPVGICHGEREYSYFNRNHSSCVFLEERGYSKLGFQMSFFLSSYVIPLALISVLYMCMLTRLWKSAPGGRVSAESRRGRKKVTRMVVVVVVVFAVCWCPIQIILLVKALNKYHITYFTVTAQIVSHVLAYMNSCVNPVLYAFLSENFRVAFRKVMYCPPPYNDGFSGRPQATKTTRTGNGNSCHDI

SEQ ID NO: 88 - protein, 569 aa, Homo sapiens
  SLC43A2
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 89 - protein, 174 aa, Artificial Sequence
  WT-FTL
SSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 90 - protein, 158 aa, Escherichia coli
  Bacterioferritin
MKGDVKIINYLNKLLGNELVAINQYFLHARMFKNWGLMRLNDVEYHESIDEMKHADKYIERILFLEGIPNLQDLGKLGIGEDVEEMLQSDLRLELEGAKDLREAIAYADSVHDYVSRDMMIEILADEEGHIDWLETELDLIGKIGLQNYLQSQIKVKD

SEQ ID NO: 91 - DNA, 507 bp, Artificial Sequence
  A34R coding sequence from strain IHD-J
atgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatctagataccaacattaaaatgtctacagataatgcggtttatcagtgtcgtaaattacgagctagattgcctagacctgatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttgaaacagtatgtaaaagtactcaatctgtactatgtgttaaaaaattctacaagtga

SEQ ID NO: 92 - protein, 148 aa, Mus musculus
  Mouse MCP-1
MQVPVMLLGLLFTVAGWSIHVLAQPDAVNAPLTCCYSFTSKMIPMSRLESYKRITSSRCPKEAVVFVTKLKREVCADPKKEWVQTYIKNLDRNQMRSEPTTLFKTASALRSSAPLNVKLTRKSEANASTTFSTTTSSTSVGVTSVTVN

SEQ ID NO: 93 - protein, 99 aa, Homo sapiens
  Human MCP-1
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 94 - DNA, 760 bp, Homo sapiens; identical to SEQ ID NO: 62
  Human MCP-1 mRNA

SEQ ID NO: 95 - protein, 97 aa, Homo sapiens
  Human eotaxin
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 96 - protein, 97 aa, Mus musculus
  Mouse eotaxin
MQSSTALLFLLLTVTSFTSQVLAHPGSIPTSCCFIMTSKKIPNTLLKSYKRITNNRCTLKAIVFKTRLGKEICADPKKKWVQDATKHLDQKLQTPKP

SEQ ID NO: 97 - protein, 520 aa, Artificial Sequence
  SIL-6R/IL-6 fusion protein
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPARGGGGSGGGGSVEPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 98 - protein, 207 aa, Artificial Sequence
  IL-24 protein
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 99 - protein, 98 aa, Mus musculus
  Mouse IP-10
MNPSAAVIFCLILLGLSGTQGIPLARTVRCNCIHIDDGPVRMRAIGKLEIIPASLSCPRVEIIATMKKNDEQRCLNPESKTIKNLMKAFSQKRSKRAP

SEQ ID NO: 100 - protein, 98 aa, Homo sapiens
  Human IP-10 Protein
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 101 - DNA, 1063 bp, Mus musculus
  Mouse IP-10 mRNA
catcccgagccaaccttccggaagcctccccatcagcaccatgaacccaagtgctgccgtcattttctgcctcatcctgctgggtctgagtgggactcaagggatccctctcgcaaggacggtccgctgcaactgcatccatatcgatgacgggccagtgagaatgagggccatagggaagcttgaaatcatccctgcgagcctatcctgcccacgtgttgagatcattgccacgatgaaaaagaatgatgagcagagatgtctgaatccggaatctaagaccatcaagaatttaatgaaagcgtttagccaaaaaaggtctaaaagggctccttaactggagtgaagccacgcacacaccccggtgctgcgatggatggacagcagagagcctctctccatcactcccctttacccagtggatggctagtcctaattgcccttggtcttctgaaaggtgaccagccgtggtcacatcagctgctactcctcctgcaggatgatggtcaagccatggtcctgagacaaaagtaactgccgaagcaagaattctttaagggctggtctgagtcctcgctcaagtggctgggatggctgtcctagctctgtactgtaagctatgtggaggtgcgacgcccttcaccatgtgccatgcccaggctgctccccacaccctccttgtcctccctagctcaggctcgtcagttctaagtttacctgagctcttttatttcagatgtaagactacaaatttaagtttgtaagcacgaacttaaccaccatcttcccaaggggttatcaagatactcagaggaacctgaaaatgtatgtgtaaatactatttaatgaacgactgtacaaagtagaattcctaatgtattttttgtatgctttgcattgtatatggaagaacttgtgtcatcaagtatgtatcaatgggtagttaaagtttatttttaaaaccgtccaataccttttgtattatgtaacattcaaaagacaatgtactgtattgaaagtagtaagagacccaaaatgtaataaagtaataataactgacatg

SEQ ID NO: 102 - protein, 91 aa, Homo sapiens
  Human RANTES
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 103 - protein, 91 aa, Mus musculus
  Mouse RANTES
MKISAAALTIILTAAALCTPAPASPYGSDTTPCCFAYLSLALPRAHVKEYFYTSSKCSNLAVVFVTRRNRQVCANPEKKWVQEYINYLEMS

SEQ ID NO: 104 - protein, 92 aa, Mus musculus
  Mouse MIP1-alpha
MKVSTTALAVLLCTMTLCNQVFSAPYGADTPTACCFSYSRKIPRQFIVDYFETSSLCSQPGVIFLTKRNRQICADSKETWVQEYITDLELNA

SEQ ID NO: 105 - protein, 92 aa, Homo sapiens
  Human MIP1-alpha
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 106 - protein, 92 aa, Mus musculus
  Mouse MIP1-beta
MKLCVSALSLLLLVAAFCAPGFSAPMGSDPPTSCCFSYTSRQLHRSFVMDYYETSSLCSKPAVVFLTKRGRQICANPSEPWVTEYMSDLELN

SEQ ID NO: 107 - protein, 92 aa, Homo sapiens
  Human MIP1-beta
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 108 - protein, 643 aa, Homo sapiens
  SLC5A5 sodium/iodide cotransporter
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 109 - protein, 664 aa, Homo sapiens
  SLC5A1 sodium/glucose cotransporter 1
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 110 - protein, 672 aa, Homo sapiens
  SLC5A2 sodium/glucose cotransporter 2
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 111 - protein, 718 aa, Homo sapiens
  SLC5A3 sodium/myo-inositol cotransporter
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 112 - protein, 659 aa, Homo sapiens
  SLC5A4 low affinity sodium/glucose cotransporter
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 113 - protein, 635 aa, Homo sapiens
  SLC5A6 sodium-dependent multivitamin transporter
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGFSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 114 - protein, 580 aa, Homo sapiens
  SLC5A7 high affinity choline transporter 1
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 115 - protein, 610 aa, Homo sapiens
  SLC5A8 sodium-coupled monocarboxylate transporter 1
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQVGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLITTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 116 - protein, 681 aa, Homo sapiens
  SLC5A9 sodium/glucose cotransporter 4
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 117 - protein, 596 aa, Homo sapiens
  SLC5A10 sodium/glucose cotransporter 5, isoform 1
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 118 - protein, 569 aa, Homo sapiens
  Sodium/glucose cotransporter 5, isoform 2
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 119 - protein, 565 aa, Homo sapiens
  Sodium/glucose cotransporter 5, isoform 3
MTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRTGIPSTPPAPQSRLSFLLPETPPLERYLLGLVVMDLWVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 120 - protein, 612 aa, Homo sapiens
  Sodium/glucose cotransporter 5, isoform 4
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 121 - protein, 675 aa, Homo sapiens
  SLC5A11 sodium/myo-inositol cotransporter 2, isoform 1
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 122 - protein, 640 aa, Homo sapiens
  Sodium/myo-inositol cotransporter 2, isoform 2
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 123 - protein, 611 aa, Homo sapiens
  Sodium/myo-inositol cotransporter 2, isoform 3
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 124 - protein, 742 aa, Homo sapiens
  Sodium/myo-inositol cotransporter 2, isoform 4
MESGTSSPQPPQLDPLDAFPQKGLEPGDIAVLVLYFLFVLAVGLWVGSPSVAQGTRTQWWQSWLTPASTSWAQVILSPRLPDTEEVLSTRNRLSPDTKPLGALILNFQVSRISTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 125 - protein, 618 aa, Homo sapiens
  SLC5A12 sodium-coupled monocarboxylate transporter 2, isoform 1
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCLLFGVMCTSMAVAASVMGGVVQASLSIHGMCGGPMLGLFSLGIVFPFVNWKGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 126 - protein, 396 aa, Homo sapiens
  Sodium-coupled monocarboxylate transporter 2, isoform 2
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCRYSWWTFYSIS

SEQ ID NO: 127 - protein, 617 aa, Homo sapiens [sequence omitted]

SEQ ID NO: 128 - protein, 630 aa, Homo sapiens
  SLC6A4 sodium-dependent serotonin transporter
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 129 - protein, 620 aa, Homo sapiens
  SLC6A3 sodium-dependent dopamine transporter
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 130 - protein, 599 aa, Homo sapiens
  SLC6A1 sodium- and chloride-dependent GABA transporter 1
MATNGSKVADGQISTEVSEAPVANDKPKTLVVKVQKKAADLPDRDTWKGRFDFLMSCVGYAIGLGNVWRFPYLCGKNGGGAFLIPYFLTLIFAGVPLFLLECSLGQYTSIGGLGVWKLAPMFKGVGLAAAVLSFWLNIYYIVIISWAIYYLYNSFTTTLPWKQCDNPWNTDRCFSNYSMVNTTNMTSAVVEFWERNMHQMTDGLDKPGQIRWPLAITLAIAWILVYFCIWKGVGWTGKVVYFSATYPYIMLIILFFRGVTLPGAKEGILFYITPNFRKLSDSEVWLDAATQIFFSYGLGLGSLIALGSYNSFHNNVYRDSIIVCCINSCTSMFAGFVIFSIVGFMAHVTKRSIADVAASGPGLAFLAYPEAVTQLPISPLWAILFFSMLLMLGIDSQFCTVEGFITALVDEYPRLLRNRRELFIAAVCIISYLIGLSNITQGGIYVFKLFDYYSASGMSLLFLVFFECVSISWFYGVNRFYDNIQEMVGSRPCIWWKLCWSFFTPIIVAGVFIFSAVQMTPLTMGNYVFPKWGQGVGWLMALSSMVLIPGYMAYMFLALKGSLKQRIQVMVQPSEDTVRPENGPEHAQAGSSTSKEAYI

SEQ ID NO: 131 - protein, 569 aa, Homo sapiens
  SLC6A13 sodium- and chloride-dependent GABA transporter 2
MDSRVSGTTSNGETKPVYHKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFPVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSWSAFLPGASTDSEPSRAPSERESVSSCAQPRTCPSGTQQDPRLPPPPGPHCSDSQS

SEQ ID NO: 132 - protein, 632 aa, Homo sapiens
  SLC6A11 sodium- and chloride-dependent GABA transporter 3
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWEHRVLAISDGIEHIGNLRWELALCLLAAWTICYFCIWKGTKSTGKVVYVTATFPYIMLLILLIRGVTLPGASEGIKFYLYPDLSRLSDPQVWVDAGTQIFFSYAICLGCLTALGSYNNYNNNCYRDCIMLCCLNSGTSFVAGFAIFSVLGFMAYEQGVPIAEVAESGPGLAFIAYPKAVTMMPLSPLWATLFFMMLIFLGLDSQFVCVESLVTAVVDMYPKVFRRGYRRELLILALSVISYFLGLVMLTEGGMYIFQLFDSYAASGMCLLFVAIFECICIGWVYGSNRFYDNIEDMIGYRPPSLIKWCWMIMTPGICAGIFIFFLIKYKPLKYNNIYTYPAWGYGIGWLMALSSMLCIPLWICITVWKTEGTLPEKLQKLTTPSTDLKMRGKLGVSPRMVTVNDCDAKLKSDGTIAAITEKETHF

SEQ ID NO: 133 - protein, 692 aa, Homo sapiens
  SLC6A5 sodium- and chloride-dependent glycine transporter 1
MAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 134 - protein, 797 aa, Homo sapiens
  SLC6A9 sodium- and chloride-dependent glycine transporter 2
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPSLRGPEGDANVSVGKGTLERNNTPVVGWVNMSQSTVVLGTDGITSVLPGSVATVATQEDEQGDENKARGNWSSKLDFILSMVGYAVGLGNVWRFPYLAFQNGGGAFLIPYLMMLALAGLPIFFLEVSLGQFASQGPVSVWKAIPALQGCGIAMLIISVLIAIYYNVIICYTLFYLFASFVSVLPWGSCNNPWNTPECKDKTKLLLDSCVISDHPKIQIKNSTFCMTAYPNVTMVNFTSQANKTFVSGSEEYFKYFVLKISAGIEYPGEIRWPLALCLFLAWVIVYASLAKGIKTSGKVVYFTATFPYVVLVILLIRGVTLPGAGAGIWYFITPKWEKLTDATVWKDAATQIFFSLSAAWGGLITLSSYNKFHNNCYRDTLIVTCTNSATSIFAGFVIFSVIGFMANERKVNIENVADQGPGIAFVVYPEALTRLPLSPFWAIIFFLMLLTLGLDTMFATIETIVTSISDEFPKYLRTHKPVFTLGCCICFFIMGFPMITQGGIYMFQLVDTYAASYALVIIAIFELVGISYVYGLQRFCEDIEMMIGFQPNIFWKVCWAFVTPTILTFILCFSFYQWEPMTYGSYRYPNWSMVLGWLMLACSVIWIPIMFVIKMHLAPGRFIERLKLVCSPQPDWGPFLAQHRGERYKNMIDPLGTSSLGLKLPVKDLELGTQC

SEQ ID NO: 135 - protein, 636 aa, Homo sapiens
  SLC6A7 sodium-dependent proline transporter
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALLVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 136 - protein, 620 aa, Homo sapiens
  SLC6A6 sodium- and chloride-dependent taurine transporter
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 137 - protein, 614 aa, Homo sapiens
  SLC6A12 sodium- and chloride-dependent betaine transporter
MDGKVAVQEYGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 138 - protein, 635 aa, Homo sapiens
  SLC6A8 sodium- and chloride-dependent creatine transporter 1
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 139 - protein, 633 aa, Homo sapiens
  Sodium- and chloride-dependent glycine transporter 1, isoform 2
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 140 - protein, 638 aa, Homo sapiens
  Sodium- and chloride-dependent glycine transporter 1, isoform 3
MAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 141 - protein, 426 aa, Homo sapiens
  SLC6A10 sodium- and chloride-dependent creatine transporter 2
IVYFTATFPYVVVVVLLVLGVLLPGALDSIIYYLKPDWSKLGSPQVWIDVGTQIFFSYAIGLGALTALGSYNRFNNNCYKDAIILAVINSGTSFFAGFVVFSILGFMAAEQGMHISKVAESGPGLAFIAYPQAVTLMPVAPLWAALFFFMLLLLGLDNQFVGVEGFITGLLNLLPASYYFCFQREISVALCCALRFVIDLSMVTDGGMYVFQLFDYYSASGTTLLWQAFWECVVVVWVYGADRFTDDIACMIGYRPCPWMKWCWSFFTPLVCMGIFIFNVVYYKPLVYNNTYVYPWWGEAMGWAFVLSSMLCMPLHLLGCLLRAKGTMAECWKHLTQPIWGLHHLEYRAQDADVRGLTTLTPVSESSKVVVVESVMGQLSSHHQLTSGSHSSPCFIPTPPLQGACLSLTLLGSAWERRGESTMSAH

SEQ ID NO: 142 - protein, 642 aa, Homo sapiens
  SLC6A14 sodium- and chloride-dependent neutral and basic amino acid transporter B(0+)
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 143 - protein, 730 aa, Homo sapiens
  SLC6A15 orphan sodium- and chloride-dependent neurotransmitter transporter NTT73
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 144 - protein, 736 aa, Homo sapiens
  SLC6A16 orphan sodium- and chloride-dependent neurotransmitter transporter NTT5
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 145 - protein, 727 aa, Homo sapiens
  SLC6A17 orphan sodium- and chloride-dependent neurotransmitter transporter NTT4
MPKNSKVTQREHSSEHVTESVADLLALEEPVDYKQSVLNVAGEAGGKQKAVEEELDAEDRPAWNSKLQYILAQIGFSVGLGNIWRFPYLCQKNGGGAYLVPYLVLLIIIGIPLFFLELAVGQRIRRGSIGVWHYICPRLGGIGFSSCIVCLFVGLYYNVIIGWSIFYFFKSFQYPLPWSECPVVRNGSVAVVEAECEKSSATTYFWYREALDISDSISESGGLNWKMTLCLLVAWSIVGMAVVKGIQSSGKVMYFSSLFPYVVLACFLVRGLLLRGAVDGILHMFTPKLDKMLDPQVWREAATQVFFALGLGFGGVIAFSSYNKQDNNCHFDAALVSFINFFTSVLATLVVFAVLGFKANIMNEKCVVENAEKILGYLNTNVLSRDLIPPHVNFSHLTTKDYMEMYNVIMTVKEDQFSALGLDPCLLEDELDKSVQGTGLAFIAFTEAMTHFPASPFWSVMFFLMLINLGLGSMIGTMAGITTPIIDTFKVPKEMFTVGCCVFAFLVGLLFVQRSGNYFVTMFDDYSATLPLTLIVILENIAVAWIYGTKKFMQELTEMLGFRPYRFYFYMWKFVSPLCMAVLTTASIIQLGVTPPGYSAWIKEEAAERYLYFPNWAMALLITLIVVATLPIPVVFVLRHFHLLSDGSNTLSVSYKKGRMMKDISNLEENDETRFILSKVPSEAPSPMPTHRSYLGPGSTSPLETSGNPNGRYGSGYLLASTPESEL

SEQ ID NO: 146 - protein, 628 aa, Homo sapiens
  SLC6A18 sodium- and chloride-dependent transporter XTRP2
MAHAPEPDPAACDLGDERPKWDNKAQYLLSCIGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNMHILQNPRVWLDAATQIFFSLSLAFGGHIAFASYNSPRNDCQKDAVVIALVNRMTSLYASIAVFSVLGFKATNDYEHCLDRNILSLINDFDFPEQSISRDDYPAVLMHLNATWPKRVAQLPLKACLLEDFLDKSASGPGLAFVVFTETDLHMPGAPVWAMLFFGMLFTLGLSTMFGTVEAVITPLLDVGVLPRWVPKEALTGLVCLVCFLSATCFTLQSGNYWLEIFDNFAASLNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 147 - protein, 634 aa, Homo sapiens
  SLC6A19 sodium-dependent neutral amino acid transporter B(0)
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 148 - protein, 592 aa, Homo sapiens
  SLC6A20 sodium- and chloride-dependent transporter XTRP3
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 149 - DNA, 1854 bp, Homo sapiens
  Norepinephrine transporter cDNA
atgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctga

SEQ ID NO: 150 - protein, 617 aa, Homo sapiens [sequence omitted]

SEQ ID NO: 151 - protein, 617 aa, Artificial Sequence
  N7K Mutant NET
MLLARMKPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 152 - protein, 617 aa, Artificial Sequence
  V69I Mutant NET
MLLARMNPQVQPENNGADTGPEQPLRARKTAELLVVKERNGVQCLLAPRDGDAQPRETWGKKIDFLLSIVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 153 - protein, 617 aa, Artificial Sequence
  T99I Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYILFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 154 - protein, 617 aa, Artificial Sequence
  V245I Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVIIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 155 - protein, 617 aa, Artificial Sequence
  T283R Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVRLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 156 - protein, 617 aa, Artificial Sequence
  N292T Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGITAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 157 - protein, 617 aa, Artificial Sequence
  V356L Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFLSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 158 - protein, 617 aa, Artificial Sequence
  A369P Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMPHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 159 - protein, 617 aa, Artificial Sequence
  N375S Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVSIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 160 - protein, 617 aa, Artificial Sequence
  V449I Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGITFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 161 - protein, 617 aa, Artificial Sequence
  A457P Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLPLFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 162 - protein, 617 aa, Artificial Sequence
  K463R Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITRGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 163 - protein, 617 aa, Artificial Sequence
  G478S Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAASTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 164 - protein, 617 aa, Artificial Sequence
  F528C Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPACLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 165 - protein, 617 aa, Artificial Sequence
  Y548H Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDHIFPPWANWVGWGIALSSMVLVPIYVIYKFLSTQGSLWERLAYGITPENEHHLVAQRDIRQFQLQHWLAI

SEQ ID NO: 166 - protein, 617 aa, Artificial Sequence
  I549T Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYTFPPWANWVGWGIALSSMVLVPIYVIYKFLSTQGSLWERLAYGITPENEHHLVAQRDIRQFQLQHWLAI

SEQ ID NO: 167 - protein, 613 aa, Homo sapiens
  NET isoform 1 (3 aa from exon 15)
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLSF

SEQ ID NO: 168 - protein, 628 aa, Homo sapiens
  NET isoform 2 (18 aa from exon 15)
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQMKTRQGRRRATNSCQISC

SEQ ID NO: 169 - protein, 615 aa, Bos taurus
  Bovine norepinephrine transporter
MLLARMNPQVQPENGGAGPGSEQPPRKRKEVLVVKERNGVQCLLASRDGDEQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTPTLPWTDCGHAWNSPNCTDPKLLNSSVLGNHTKYSKYKFTPAAEFYERGVLHLHESSGIHDIGLPQWQLLLCLIIVVIVLFFSLWKGVKTSGKVVWITATLPYLVLFVLLVHGITLPGASNGINAYLHIDFYRLKEATVWIDAATQIFFSLGAGFGVLIAFASYNKFDNNCYRDALLTSTINCVTSFISGFAIFSILGYMAHEHKVNIEDVATEGAGLVFILYPEAISTLSGSTFWAIVFFIMLLALGIDSSMGGMEAVITGLADDFQVLKRHRKLFTFAVSFGTFLLALFCITKGGIYVLTLLDTFAAGTSILFAVLMEAIGVSWFYGVDRFSNDIQQMMGFKPGLYWRLCWKFVSPAFLLFVVIVSIINFKPLTYDDYIFPLWANWVGWGIAGSSMVLVPAYIVYKFFSTRGSIRERLAYGITPASEHHLVAQRDIRQFQLQHWLAI

SEQ ID NO: 170 - protein, 617 aa, Mus musculus
  Mouse norepinephrine transporter
MLLARMNPQVQPELGGADPLPEQPLRPCKTADLLVVKERNGVQCLLASQDSDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFASFTLNLPWTNCGHSWNSPNCTDPKLLNASVLGDHTKYSKYKFTPAAEFYERGVLHLHESSGIHDIGLPQWQLLLCLMVVIVVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSTINCVTSFISGFAIFSILGYMAHEHKVNIEDVATEGAGLVFILYPEAISTLSGSTFWAVLFFLMLLALGLDSSMGGMEAVITGLADDFQVLKRHRKLFTCVVTISTFLLALFCITKGGIYVLTLLDTFAAGTSILFAVLMEAIGVSWFYGVDRFSNDIQQMMGFKPGLYWRLCWKFVSPAFLLFVVVVSIINFKPLTYDDYTYPPWANWVGWGIALSSMILVPAYVIYKFLSIRGSLWERVAYGITPENEHHLVAQRDVRQLPLQHWLAI

SEQ ID NO: 171 - protein, 617 aa, Rattus norvegicus
  Rat norepinephrine transporter
MLLARMKPQVQPELGGADQLPEQPLRPCKTADLLVVKERNGVQCLLASQDGDAQPRETWGKEIDFLLSVVGFAVDLANVWRFPYLCYKNGGGAFLIPYTLFLIIAGMPLFYMELALGQFNREGAATVWKICPFFKGVGYAVILIALYVGFYYNVIIAWSLYYLFASFTLNLPWTNCGHAWNSPNCTDPKLLNASVLGDHTKYSKYKFTPAAEFYERGVLHLHESSGIHDIGLPQWQLLLCLMVVIVVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSTINCVTSFISGFAIFSILGYMAHEHKVKIEDVATEGAGLVFVLYPEAISTLSGSTFWAVLFFLMLLALGLDSSMGGMEAVITGLADDFQVLKRHRKLFTCAVTLGTFLLAMFCITKGGIYVLTLLDTFAAGTSILFAVLMEAIGVSWFYGVDRFSNDIQQMMGFKPGLYWRLCWKFVSPAFLLFVVVVSIINFKPLTYDDYVYPPWANWVGWGIALSSMILVPAYVIYKFFSIRGSLWERVAYGITPENEHHLVAQRDVRQFQLRHWLAI

SEQ ID NO: 172 - protein, 617 aa, Macaca mulatta
  Rhesus macaque norepinephrine transporter
MLLARMNPQVQPENSGADAGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVVVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFIMLLALGLDSSMGGMEAIITGLADDFQVLKRHRKLFTFGVTFGTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDVRQFQLQHWLAI

SEQ ID NO: 173 - protein, 635 aa, Gallus gallus
  Chicken norepinephrine transporter
MGQRHPQCYLARMNKQIQPDRKVSVVAPLPERPGPSPPRKDVELILVKEHNGVQYTSSNLLPAAPAPRYGPQDRETWGKKIDFLLSVIGFAVDLANVWRFPYLCYKNGGGAFLIPYILFLIIAGMPLFYMELALGQYNREGAATVWKICPVFKGVGYAVILIALYVGFYYNVIIAWSLYYLFSSFTFELPWTNCDNSWNSPNCTDPKLFNASVLGNGTKYSKYKLTPAAEFYERGVLHLHESRGIHDLGLPRWQLSLCLLVVVIILFFSLWKGVKTSGKVVWITATLPYVVLFVLLIHGITLPGAYNGINAYLHIDFRRLKEATVWIDAATQIFYSLGAGFGVLIAFASYNKFDNNCYRDALLTSTINCVTSFISGFAIFSILGYMAHEHKVKIEDVATEGAGLVFILYPEAISTLSGSTFWAVVFFIMLLTLGIDSSMGGMEAVITGLADDFHILKQHRKLFTFGVSFGTFLLALFCITNGGIYVLTLLDTFAAGTSILFAVLMEAIGVSWFYGVDRFSEDIQQMMGFKPGLYWRLCWKFVSPAFLLFVVIVSIINFKPLTYDDYTFPFWANRIGWGIALSSMILVPAYVIYKFMNVRGTFKERLAYCITPENEHQLVAQGNVRQFKLQHWLTI

SEQ ID NO: 174 - protein, 106 aa, Ovis aries
  Ovine norepinephrine transporter fragment
  VARIANT (4)...(4): Xaa=unknown
  VARIANT (10)...(10): Xaa=unknown
  VARIANT (41)...(41): Xaa=unknown
  VARIANT (53)...(57): Xaa=unknown
  VARIANT (64)...(64): Xaa=unknown
  VARIANT (90)...(90): Xaa=unknown
  VARIANT (99)...(100): Xaa=unknown
RLLXPYTLFXIIAGMPLFYMELALGQYNREGLPPFGNLPIXQRRWLCCHPDRXXXXXYNNVIIXWSLYYLFSSFTLNLPWTDCGHTWNSXNCTDTKLLXXSVLNHT

SEQ ID NO: 175 - protein, 515 aa, Coturnix coturnix japonica
  Japanese quail norepinephrine transporter fragment
ENWGKKIDFLLSVIGFAVDLANVWRFPYLCYKNGGGAFLIPYILFLIIAGMPLFYMELALGQYNREGAATVWKICPVFKGVGYAVILIALYVGFYYNVIIAWSLYYLFSSFTFELPWTNCDNSWNNPNCTNPKLFNASVLGNGTKYSKYKLTPAAEFYERGVLHLHESRGIHDLGLPRWQLSLCLLVVVIILFFSLWKGVKTSGKVVWITATLPYVVLFVLLIHGITLPGAYNGINAYLHIDFRRLKEATVWIDAATQIFYSLGAGFGVLIAFASYNRFDNNCYRDALLTSTINCVTSFISGFAIFSILGYMAHEHKVKIEDVATEGAGLVFILYPEAISTLSGSTFWAVVFFIMLLTLGIDSSMGGMEAVITGLADDFHILKQHRKLFTFGVSFGTFLLALFCITNGGIYVLTLLDTFAAGTSILFAVLMEAIGISWFYGVDRFSEDIQQMMGFKPGLYWRLCWKFVSPAFLLFVVIVSIINFKPLTYDDYTFPLWANRIGWGIALSSMLLVPA

SEQ ID NO: 176 - protein, 618 aa, Mus musculus
  Mouse NIS
MEGAEAGARATFGPWDYGVFATMLLVSTGIGLWVGLARGGQRSADDFFTGGRQLAAVPVGLSLAASFMSAVQVLGVPAEAARYGLKFLWMCVGQLLNSLLTALLFLPIFYRLGLTSTYQYLELRFSRAVRLCGTLQYLVATMLYTGIVIYAPALILNQVTGLDIWASLLSTGIICTLYTTVGGMKAVVWTDVFQVVVMLVGFWVILARGVMLMGGPWNVLSLAQNHSRINLMDFDPDPRSRYTFWTFVVGGSLVWLSMYGVNQAQVQRYVACHTERKAKLALLVNQLGLFLIVASAACCGIVMFVYYKDCDPLLTGRIAAPDQYMPLLVLDIFEDLPGVPGLFLACAYSGTLSTASTSINAMAAVTVEDLIKPRMPSLAPRKLVFISKGLSFIYGSTCLTVAALSSLLGGGVLQGSFTVMGVISGPLLGAFTLGMLLPACNTPGVLSGLTAGLAVSLWVAVGATLYPPGEQTMGVLPTSAAGCTNASVLPSPPGAANTSRGIPSSGMDSGRPAFADTFYAVSYLYYGALGTLTTMLCGALISYLTGPTKRSSLGPGLLWWDLARQTASVAPKEDTTTLEDSLVKGPEDIPAATKKPPGFRPEAETHPLYLGHDVETNL

SEQ ID NO: 177 - protein, 618 aa, Rattus norvegicus
  Rat NIS
MEGAEAGARATFGAWDYGVFATMLLVSTGIGLWVGLARGGQRSADDFFTGGRQLAAVPVGLSLAASFMSAVQVLGVPAEAARYGLKFLWMCAGQLLNSLLTAFLFLPIFYRLGLTSTYQYLELRFSRAVRLCGTLQYLVATMLYTGIVIYAPALILNQVTGLDIWASLLSTGIICTLYTTVGGMKAVVWTDVFQVVVMLVGFWVILARGVILLGGPRNVLSLAQNHSRINLMDFDPDPRSRYTFWTFIVGGTLVWLSMYGVNQAQVQRYVACHTEGKAKLALLVNQLGLFLIVASAACCGIVMFVYYKDCDPLLTGRISAPDQYMPLLVLDIFEDLPGVPGLFLACAYSGTLSTASTSINAMAAVTVEDLIKPRMPGLAPRKLVFISKGLSFIYGSACLTVAALSSLLGGGVLQGSFTVMGVISGPLLGAFTLGMLLPACNTPGVLSGLAAGLAVSLWVAVGATLYPPGEQTMGVLPTSAAGCTNDSVLLGPPGATNASNGIPSSGMDTGRPALADTFYAISYLYYGALGTLTTMLCGALISYLTGPTKRSSLGPGLLWWDLARQTASVAPKEDTATLEESLVKGPEDIPAVTKKPPGLKPGAETHPLYLGHDVETNL

SEQ ID NO: 178 - protein, 601 aa, Danio rerio
  Zebrafish NIS
MAMDSDRPPGFCLVDYAVFAAMLGVSVGIGLFQSLRKTPGRSKVDSFFTGGRGFSAVPVGLSLCASFMSAVQVLGVPSETYLYGFKFLYMCLGQGLNSLMTAVLFVPVFYRLKITSSSQYLGMRFGRGMQLLGSLQFIVATLLYTGIVIFAPAVILNQATGLNMWASLFSTGLICTFYTTVGGMKAVIWTDVFQIVVMLSGFIAVFIQGTILAGGPARVLEIANNGSRINFNDFAIDPQRRYSFWSFTVGGTMVWLSMYGANQAQVQRYISCRTEKQAQLALLVNQVGLCLIVSSAATCGIVMFALYSNCDPLKIGRISAPDQYMPYLVLDIFRNHPGFPGLFLACAYSGTLSTVSTSINAMAAVTMEDVMKPWLITISQRKQLMLSRALSLFYGLGCITMAALSSLLDWGVLQGSFTVMGVVNGPLLGAFALGMFVPATNKPGVFSGVAVGFCLSLWLAVGSTIYPPSPQIMGVLPTSAGQCLTTNATLNTTASVLASSVPLDYSFQNIYSISYLYFGALSTSAVVLVGVVVSYITGPTKKDSISPGLLRWNLEQKPCDASCHILNETITLNPTEILLTPKELFPIAADKQDILLTKGEI

SEQ ID NO: 179 - protein, 684 aa, Xenopus laevis
  African clawed frog NIS
MDTQCWKHLLPPFLLNLWAPAQHLQHTFVSSHRSPGTELMEEYVPLVHESLTFSLWDYGVFAVMLLMSTGIGLFYAFSHGGQKTSDDFFTGGRSMSAVPVGLSLSASFMSAVQVLGVPAESYRYGVKFLQMCIGQILNSLMTAYIFMPIFYRLGITSTYEYLEMRFSRSVRLYGTIQFLLGTMFYTGIVIYAPALILNQVTGLDIWASLFSTGAICTFYTTVGGMKAVIWTDVFQVLVMLSGFFAVAIRGIHLVGGFSDAIEIAGNYSRINFGDFDPDPRRRYTFWTFVMGSTFLWLSMYGVNQAQVQRYVACKTENEAKLAILVNQVALCVIVSSAVTCGIVMFVYYLNCDPLLAGYVSAPDQYMPYFVLEIFDQYPGIPGLFLACAYSGTLSTASTSINAMAAVTVEDLIKPKYPNIPTKKLTFISKGLSLIYGCSCITVAALSSLLGGGVLQGSFTVMGVISGPLLGAFMLGMFFVSCNTIGVFAGLLVGLVLSLWVAVGGTIYPPSAEMMGVLPTYAEHCPLFNSSKGIIYGPAPVQNITHTMERPALAEDLYALSYLYYGVVGTFSTIIIGVIVSKFTGPTKRETIAPGLLWWDLSNSAAFQPMEKKDDLEKTEVEETLLKKDNTFHCTTFLPNHLPHSETSTYLLSEEYSPGNDSYSNGEKTYPLKTINGYEDKESRV

SEQ ID NO: 180 - protein, 643 aa, Homo sapiens; identical to SEQ ID NO: 108
  Human NIS

SEQ ID NO: 181 - DNA, 1929 bp, Homo sapiens
  Human NIS ORF
atggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctc

SEQ ID NO: 182 - protein, 643 aa, Homo sapiens
  G93R mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLRQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 183 - protein, 643 aa, Homo sapiens
  A102P mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTPLLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 184 - protein, 643 aa, Homo sapiens
  Q267E mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVERYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 185 - protein, 643 aa, Homo sapiens
  T354P mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSPASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 186 - protein, 643 aa, Homo sapiens
  G395R mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYRSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 187 - protein, 643 aa, Homo sapiens
  T536Q mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGQLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 188 - protein, 643 aa, Homo sapiens
  G543E mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCEALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 189 - protein, 643 aa, Homo sapiens
  S556Q mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRQTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 190 - protein, 121 aa, Homo sapiens
  Human plasminogen kringle 5 domain
MYRMQLLSCIALSLALVTNSPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFD

SEQ ID NO: 191 - DNA, 194711 bp, Vaccinia virus
  Vaccinia virus Western Reserve
atttaaaatataatattaatgtactaaaacttatatattattaatttatctaactaaagttagtaaattatatatataattttataattaatttaattttactaattttatttagtgtctagaaaaaaatgtgtgacccatgactgtaggaaactctagagtgtaagaaagatcgatcgctttatagagaccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaaagagatagttgatctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttaaatccatccttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagccagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcacatgcatgccaggacgatatattgtttcatgattgctattgattgagtactgttctttatgattctacttccttaccgtgcaataaattagaatatattttctacttttacgagaaattaattattgtatttattatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgataccgtcatcattctttgctttcgttaactgtttggaggaaaaatttttgttattgcatttaatctcgaaattcagagtgcacacctttctcctgtaaagaaacctgaagttgctaccttattaaggacggagaagtattcctcacgaaatacgggattacagtctttatgattcatagtaatagttagttccgacgttgagatggattcgctgagaccggtagtggtcgttaactggatacagattaatttccacatcgatatagttaaaggtattactgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacggtcgcgtcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgtcgtcttgttcctgtttcctacttctccaatcatatagatattttctttctatcatggataatatttgtaatggttcttttcgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctattatcttctttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagttcatcctcgtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtgaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaacagaacaatatatttttttagtaatgtttatgcgagacatataaaataaactccgtgtttatgatcatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggctgagtatgcataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacgcactacttcagccaaatattcttttttgaaacgccatctatcgtagtgaggacacaagtgaacctataattatcaaatttattagtatcagtcacatgaaggactttctgtagagtgacgattctaccatctatggtactaacggtttcatcctccttgataccctcacccaaatgttctataaatttagcatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgtcggaaataatatcatatgcttccacatatattttattttgttttaactcataatactcacgtaattctggattattggcatatctatgaataattttagctccatgatcagtaaatattaatgagaacatagtattaccacctaccattatttttttcatttcgttcaattcttgattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacacaatctaatgtaggtttatgacataatagcattttcagcagttcaatgtttctagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtattcgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccagatagtcaaacattttgactgaatgagctactgtgaactctatacacccacacaactaatgtcattaaatattatttttttgaatgtatttataccatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaactaacgaatatcaacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaatcagtttaggaagaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagcgatagtttgtagagatcttataaaaccgtcaaacgacatcgcatttatatctttagctaattcatatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgttttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcggaacatcaattattatggcagcaactagtatcatttctacattgtttatggtgatgtttatcttcttccagcgtatatagtctaatagcgattcaaacgcgtgatagtttataccattcaatataatcgcttcatcctttagatggtgatcctgaattcgtttaaaaaaattatacggagatgccgtaataatttccttattcacttgtataatttccccattgatagaaaatatcacgctttccattcttgaagtactataagtaattatagtataatgtaaaggtttatatattcaatattttttataaaaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattaaaatattattagggtcagtactcattatcattcggcagctattacttattttatttttctgtattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagtaatttaactattttagttaacaactattttttatgttaaatcaattagtacaccgctatgtttaatacttattcatattttagtttttaggattgagaatcaatacaaaaaattaatgcatcattaattttagaaatacttagtttccacgtagttaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcctaaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacaaagtctacactaaaatgattgaacaatagatagtctaccattgtttcgtattcagatagtacagcgtagtacatagcatcttcacaaattatatcattgtctaatagatatttgacgcatcttatggatcccacttcaacagccatcttaaaatcggtagaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgctatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatagagcataatccttctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtctacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatatacgccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaactgacacttgtctgtctatagcggctcttcttaattcatcttctatataaggccaaaacaaaatattgcctgccttcgaataaataatagggataaagttcataacagatacataaacgaatttactcgcatttctgatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatcttgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttagtgtgatggttcccataagtttggcagctagcagattcagttttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaataatcatcgcatatagtatgcgatagtagagtaaacatttttatcgtttctactgggttcatacatcgtctacccaattcggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccgcctcctatatcaatgccttttagggacagaccagacctaggagctattctaccatagcagaacttaggcatggacatactaatatctgtcttaattaactgtcgttctcctggagggatagtataatcgtaagcgctatataaatcatatccggcggcgtaaggtgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctaaagaaaaatgattatcttcttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgacattcatgggtgctgaataatcgttattatcatcattatcattttgtaattgtgacatcatactagataaatcgtttgcgagattgttgtgggaagcgggcatggaggatgaattatcgttattattatttaacgcctcccattcggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagttgtaacgatgactccatcttttagatgcgatactcctttgtatgtaccagaatcttcgtaccgcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaagctgctcctgttcttgttgtagtcgccgactgtcgtgtttgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgttcaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatgttgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaatttctttggtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcagttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtaactgcgttcaagtcataaatcatcttgatactatccagtaaaccgtgtttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtgactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacagccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccacggccttcttcatttcgtgccaaaataatatacagtcttaaataattacgcaatatctcaatagtttcataattgttagctgttttcatcaagatttgtaccctgtttaacatgatggcgttctatacgtctctattttcttttttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataagcatgtccaatacgttagacaacacaccgacgatggcggccgccacagacacgaatatgactagaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagcccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattgcatgttttcatattcattaggattatcaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgacaacgtggcgtcgagacttttgaactaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagttctagaattagtctgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcctaaataggtttctataatctttaatgtaatattaggaagagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaattttcagttcttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactaaacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatgtctacacaggcataaaatgtaggagagttactaggccccactgattcaatacgaaaagaccaatctctcctagtaatttggcagtactcattaataacggtgacagggttagcacctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgctcgtcgatatagattttagacatttttagagagaactaacgcaatcagtaataaaactaatttattttatcattttttttattcatcatcctctggtggttcgtcgtttctatcgaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataattagtgaaagtcagtgtccgatgatcaatgacgatagctttactctgaaaagaaagtatcaaatcgatagtgcggagtcaacaataaaaatggataagaagaggacaaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacacaatacaatcgtacaaggaaaccgtgcataaactaacacaagatgaaaaatttttagaggttgccaaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactcctttgctatttctatggacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacaaatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgctcgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcacaaaccaccggtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaaaattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagtgatagatcgtgcaggttaaatagaatgctcttaaataatgtcatttttttatccgctaaaaatttaaagaatgtataaacttttttcaaagatttaaaacttttaggtggtgtcctagtacacaatatcataaacaaactaataaacatcccgcattcagattccaacagctgattaacttccacattaatacagcctattttcgctccaaatgtacattcgaaaaatctgaataaaacatcaatgtcgcaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaaaacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttctacatctccttttgtagacacgactaaacattttgcaaaaaaaagtttattagtgtttagataatcgtatacttcatcagtgtagatagtaaatgtgaacaaataaaaggtattcttactcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaattcaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactttgcgagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatctgttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtatgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatcaacatatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaataaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctatagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatctcacaactttactgtttttgaactgttcaaaatatagcatagatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatatcctaaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatctcgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtataccttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatattacatccggcaaaaataatatgattagaagttatatcgtcgcccgacgaaaagatcagacggctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggagatgaagaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggacgaggataatattagatttactgtctatctaaatttcgttgaaccagaggaattgaatcttagtaagtttatgatggttcttccgggggcagccaacaagggaaagattagtaaattcaagattcctatctctgattatacgggttatgacgacttcaatcaaacaaaaaagctcaataagatgactgtagaactcatgaatctaaaagaattaggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaattcggtttcatgttttcgaaacggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaagtctatcaataactggcacaacaataacaggagttttcgccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttcgaccgatggagtaggtgcaacaattttttgttcgatgtatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataagccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaaaaccgataaatggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaatttacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagagtcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccatctacaagaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttttaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtagataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttatatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgaaatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcacgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaattcggaaatgtaattctaaaacttacaacgcgcgataaattatttaataaagtatatataggttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatatttttgttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattgattgagaagaagctaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctcccaatagttctccccttttaaaggtatctaatgcagatttagaaaattctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttttcatcaactagacgtttattctcaaatagcgattggtgttgtaaggatcctggtcgtagtaagttaaccaacatggtgaattcttgcacactattgacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatcttttaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtggaccatcgctaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaatgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggaacagtactactaggtagaagaataggagccggtgtagctgttggaaccggctgtggagttatatgaatagttggttgtagcggttggataggctgtctgctggcgaccgtcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattttttcttgttatccgatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacataatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcatatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcgatttgatgaacacacgatgaaaatgtgcttctatgagattgatcatgtagaaaacaacaagggatacaatatttccgcatatcatgaaatatattaagaaatcccaccttattatatttccccaaaggatccatgcatgtaaacattatgccgttatcattaataaagacttctttctcatcggatttgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcacatgctcttgccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattttttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcttttgtttagaacgattagctacagagttcaacgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaatcaatttttctgcctcgtttttactacaactagttttcatcaatgtagcgacgatgtattgtttagttactcttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacatactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacttttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttggaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacaaaaaattatcgtcactaacgtgattattattgtcataaacattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctaacggtaccataaactattttaccagcattagtaacagcttggacaatctgaccatccatcgcattgtacgatgtagtagtaactgttgttctacgtctaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatacagaagatttaactagattatacaatgaactaatatgatccttttccagattatttacaaacttggtattttttggttctggaggaggcgaatttaaattcggacttggattcggattttgtgagttcttgatcttattatacatcgagtataggatggcgacggtaactgctacacaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatagatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccagctaaccgaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaagaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctataacacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatctaaggttagagaacatacatttgtaaaagtaaaaaagaaaaacacattttccattttatacgactatgatgggaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcagattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtatataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtacttacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgatgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagataaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttaaaagactcagaagaggattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagattccaattcacgttcgcatgggttacctccgcagtttttacgagcgatttcacgttcagccttcatgcgtctctccttctctctatcgagtttatcagagcagtctttctgaaggcgatcgaactccataaatttctccaacgctttgattgtttccatagatttccgaagttcagcttttaggactgtgattctttttctttcgaattcacagctggatgtgcaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacgtctgaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaagaggaaatattcagtatatagatatgccttagcatcatatcttgtactaaacacgctaaacagtttattgatgtgatcaatttccaacagaataattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttttacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaaaccatataatatatattcagggacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataaaatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatgggcgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcacctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcaaggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgttgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgtcatggcgcctagcacagaacacatttacgatagtgttgctggaagcacgctgctaataaataatgatcgtaatgaacagactatttatcagaacactacagtagtaattaatgagacggagactgttgaagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattccccatagactatcgactattatactctgtattagttctgtcggaggatgtgttatctctatagataatgacatcaatgacaaaaatattctaacatttcccattgatcatgctgtaatcatatccccactgagtaaatgtgtcgtagttagcaagggtcctacaaccatattggttgttaaagcggatatacccagcaaacgattggtaacatcgtttacaaacgacatactgtatgtaaacaatctgtcactgattaattatttgccgttgtctgtattcattattagacgagtcaccgactatttggatagacacatatgcgatcagatatttgcgaataataagtggtattccattataaccatcgacgataagcaatatcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtatacgtacctggtaagatatctttatattctataatcaatgagacatcactatccgataacgaatgaagtctagcactagtatgccatttacttaatatggtcgtcttggaagttttattataagttaaaatatcatggttgtccaatttccatctaatatactttgtcggattatctatagtacacggaataatgatggtattattacatgctgtatactctatagtctttgtagatgttataatcataaaagtacagaggtatatcaacgatattctaactcttgacattttttatttatttaaaatgatacctttgttatttattttattctattttgctaacggtatcgaatggcataagtttgaaacgagtgaagaaataatttctacttacttattagacgacgtattatacacgggtgttaatggggcggtatacacattttcaaataataaactaaacaaaactggtttagctaatactaattatatcacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacattagaaggaggaacagttttaaagtctcttggttttaatctattaccgttagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaatagatcaacagaaatatttaatcctccgtttgatacagatgcaccatatttatggattttggattcacacgttgtttgtctgaggggttcgtctagcgttgcttctacataaacttctattcccatatattctttattgtcagaatcgcataccgatttatcatcatacactgtttgaaaactaaatggtatacacatcaaaataacaaatactaacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgcgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcaacatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttatttggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtctcatagatgtatagaggtcagatactggtttgataaactgtttattccacatgagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattattttatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgacctatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcgttctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtgagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagacgtggatagtttcttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggttttgcaagaccaattaacgatggttaaaattaacaaggatcccaaaaaaattccagagtggttggtagttaataaaatctatattcccgattttgtagtagaggatccgaaacaatctcagatatgggaaatttcaggagcagagtttacatcttccaagtcccataccgcaaatggaatatccattagatttcctagatttactaggattagagaagataaaacgtggaaagaatctactcatctaaacgatttagtaaacttgactaaatcttaatagttacatacaaactgaaaattaaaataacactatttagttggtggtcgccatggatggtgttattgtatactgtctaaacgcgttagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagctattaaactgtttattaatgatcacatgcttgataagataaaatctatactgcagaatagactagtatatgtggaaatgtcatagaaagttaaaagttaatgagagcaaaaatatataaggttgtattccatatttgttattttttctgtaatagttagaaaaatacattcgatggtctatctaccagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatcccaattattctaatggatgtcatcaatgtagaaaatgcccaaccggatcatttgataaggtaaagtgtaccggaacacagaacagtaaatgttcgtgtcttcctggttggtattgtgctactgattcttcacagactgaagattgttgaaattgtgtaccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattagtatagttattaatgatgaaaggataaacgctcataaactcatcctatctggagcctccgaatatttttccattctgttttccaataattttatcgattctaatgaatacgaagttaatctaagtcatttagattatcaaagcgttaacgatttgatcgattacatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgataaatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggagaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattatgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcacttagtccaggacctatcattgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgtcgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttcctttatactctcatcttttaccaacacaaagggtggatatttgttcattggagttgataataatacacacaaagtaattggattcacggtgggtcatgactacctcagactggtagagaatgatatagaaaagcatatcaaaagacttcgtgttgtgcatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaatagattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaatgataaacagaaagttacgtttacatgtgatcagggatatcattcttcggatccaaatgctgtctgcgaaacagataaatggaaatacgaaaatccatgcaaaaaaatgtgcacagtttctgattacatctctgaattatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaatggattaatttccggatctacattttctatcggtggcgttatacatcttagttgtaaaagtggttttacactaacggggtctccatcatccacatgtatcgacggtaaatggaatcccgtactcccaatatgtgtacgaactaacgaagaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataatgaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacaatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcaaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatttaatattagactatctctatcgcgctacacgaccaatatcgattactatggatatcttcagggaaatcgcatcttctatgaaaggagagaatgtattcatttctccagcgtcaatctcgtcagtattgacaatactgtattatggagctaatggatccactgctgaacagctatcaaaatatgtagaaaaggaggagaacatggataaggttagcgctcaaaatatctcattcaaatccataaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatgcagagtatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatagttaatatattgtgaacaacaagagcagatatctataggaaagggtggaatgcgatacattgatctatgtagttttaaaacacacgcaaactttgaagaatttatataaatcattccatcgatacatccttctatgttgagatgtatatatccaggaattcgtttattaatatcgggaaatgtataaactaaaacattgcccggaagcggagcttctaccggagttatatcagtttttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggaatctaacgcacatcgtcgtacgtttatacaattgtgatttagtgtagtatatctacacatgtatttttccgcgctatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtcctgcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcgattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaccgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggaaaggctagaaaaaaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattatttatctagcgattatgaaaattataatgaatattattatgatgattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaatgacgatggaatgataccagtagtttactgtatacactcaaatgccgaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaaatagcatagatatggaggaggatacaaatatttcaaataaagttataaggtacaacactgtcaataatatatgggaaacattacctaacttctggactggaactataaatccaggcgtggtctcgcataaagatgatatatatgttgtatgcgacatcaaagatgaaaaaaatgttaaaacttgtatatttagatataacacgaatacgtataacggatgggaattggtcacgacgacagaaagcagattatcagctctgcatactattctttataacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaagtttaacattatttatttatgatatatatcgttattgtttggtctataccatggatatctttaaagaactaatcttaaaacacacggatgaaaatgttttgatttctccagtttctattttatctactttatctattctaaatcatggagcagctggttctacagctgaacaactatcaaaatatatagagaatatgaatgagaatacacccgatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgagcactgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccatttcggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattctttttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcaagattatattagaatcaaattaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatgcatgttatgcaaaatatatgagtacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtattgggagtataggtattattagctatgtaccaatttaccaaccctcttaatattgattgaacaatcacatcggttatccaatcaataaccacattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatgtaatgttattaatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgcatactcagccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgatagtacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacattttttttgtaaaaatactcataaaaaaatttataaaaattatggcacaaccatatcttgtataggtagtttagttcgtcgagtgaacctataaacagataatagacaacacgtaataataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcgatgtcgtttcgatagcgttaccactatcggcgaatgatctgattatcatagcagcgaacaacaacatcagatatttcatcgacatttttgatggattttgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgatcataaacacggagtttattttatatgtctcgcataaacattactaaaaaaatatattgttctgtttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtatttcacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacaccactatcaatcgataacaagatctttgatatactaacggacaccattgatgactttagtaaatcatccgatctattgctgtgttatcttagatataaattcaatgggagcttaaactattacgttctgtacaaaggatccgacgaggatgaactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaagaagataatagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacgaaaagaaccattacaaatattatccatgatagaaagaaaatatctatatgattggagaagtaggaaacaggaacaagacgacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagacgcgaccgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagtaatacctttaactatatcgatgtggaaattaatctgtatccagttaacgaccactaccggtctcagcgaatccatctcaacgtcggaactaactattactatgaatcataaagactgtaatcccgtatttcgtgaggaatacttctccgtccttaataaggtagcaacttcaggtttctttacaggagaaaggtgtgcactctgaatttcgagattaaatgcaataacaaaaatttttcctccaaacagttaacgaaagcaaagaatgatgacggtatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtactcaatcaatagcaatcatgaaacaatatatcgtcctggcatgcatgtgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctctggctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaaggatggatttaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagatcaactatctctttctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggtctctataaagcgatcgatctttcttacactctagagtttcctacagtcatgggtcacacatttttttctagacactaaataaaattagtaaaattaaattaattataaaattatatatataatttactaactttagttagataaattaataatatataagttttagtacattaatattatattttaaat

(The sequence listing continues in the following parts.)

What is claimed is:

1. A pharmaceutical composition, comprising an isolated clonal LIVP strain, wherein:
   the genome of the clonal LIVP strain is not modified to contain non-viral heterologous nucleic acid containing an open reading frame encoding a non-viral heterologous protein;
   the genome of the clonal strain comprises the sequence of nucleotides selected from among:
      a) nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7, or and nucleotides 6,899-181,870 of SEQ ID NO:8; and
      b) a sequence of nucleotides that has at least 99% sequence identity to the sequence of nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7 or nucleotides 6,899-181,870 of SEQ ID NO:8;
   the clonal LIVP strain has greater anti-tumorigenicity or reduced toxicity or both compared to GLV-1h68;
   GLV-1h68 has the sequence of nucleotides set forth in SEQ ID NO: 9;
   the genome of the clonal LIVP strain comprises a sequence of nucleotides that has at least 95% sequence identity with the sequence of nucleotides set forth in SEQ ID NO:10 but does not comprise the sequence of nucleotides set forth in SEQ ID NO:10; and
   the isolated clonal strain is produced by or obtainable by a method comprising:
      (i) preparing a clonal isolate from an LIVP virus sample;
      (ii) assaying the clonal isolate for toxicity;
      (iii) assaying the clonal isolate for anti-tumorigenicity; and
      (iv) selecting the clonal isolate that exhibits greater anti-tumorigenicity and/or reduced toxicity compared to GLV-1h68.

2. A pharmaceutical composition, comprising an isolated clonal LIVP strain, wherein the genome of the clonal LIVP strain comprises the sequence of nucleotides set forth in any of SEQ ID NOS: 1, 2, 4, 5, 6, 7 and 8.

3. The pharmaceutical composition of claim 1, wherein the clonal strain has reduced toxicity compared to the virus designated GLV-1h68 having a sequence of nucleotides set forth in SEQ ID NO:9.

4. The pharmaceutical composition of claim 1, wherein the clonal strain has greater anti-tumorigenicity compared to the virus strain designated GLV-1h68 having a sequence of nucleotides set forth in SEQ ID NO:9.

5. The pharmaceutical composition of claim 1, wherein the clonal strain has reduced toxicity and greater anti-tumorigenicity compared to the virus designated GLV-1h68 having a sequence of nucleotides set forth in SEQ ID NO:9.

6. A pharmaceutical composition, comprising an isolated clonal LIVP strain, wherein:
   the genome of the clonal strain comprises the sequence of nucleotides selected from among:
      a) nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7, or nucleotides 6,899-181,870 of SEQ ID NO:8; and b) a sequence of nucleotides that has at least 99% sequence identity to the sequence of nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7, or nucleotides 6,899-181,870 of SEQ ID NO:8;

the clonal strain has greater anti-tumorigenicity and/or reduced toxicity compared to GLV-1h68; and GLV-1h68 has the sequence of nucleotides set forth in SEQ ID NO:9.

7. The pharmaceutical composition of claim 6, wherein the genome of the clonal strain consists of the sequence of nucleotides selected from among:
   a) nucleotides 1 to 183,369 of SEQ ID NO:1, nucleotides 1-193,964 of SEQ ID NO:2, nucleotides 1-187,653 of SEQ ID NO:4, nucleotides 1-188,863 of SEQ ID NO:5, nucleotides 1-188,082 of SEQ ID NO:6, nucleotides 1-188,082 of SEQ ID NO:7, or nucleotides 1-188,768 of SEQ ID NO:8; and
   b) a sequence of nucleotides that has at least 99% sequence identity to the sequence of nucleotides 1 to 183,369 of SEQ ID NO:1, nucleotides 1-193,964 of SEQ ID NO:2, nucleotides 1-187,653 of SEQ ID NO:4, nucleotides 1-188,863 of SEQ ID NO:5, nucleotides 1-188,082 of SEQ ID NO:6, nucleotides 1-188,082 of SEQ ID NO:7, or nucleotides 1-188,768 of SEQ ID NO:8.

8. A cell culture or isolated cell, comprising a clonal LIVP strain, wherein:
   the genome of the clonal LIVP does not contain non-viral heterologous nucleic acid containing an open reading frame encoding a non-viral heterologous protein;
   the clonal LIVP strain has greater anti-tumorigenicity or reduced toxicity or both compared to GLV-1h68, wherein GLV-1h68 has the sequence of nucleotides set forth in SEQ ID NO: 9;
   the genome of the clonal LIVP strain comprises a sequence of nucleotides that has at least 95% sequence identity with the sequence of nucleotides set forth in SEQ ID NO:10 but does not comprise the sequence of nucleotides set forth in SEQ ID NO:10; and
   the isolated clonal strain is produced by or obtainable by a method comprising:
   (i) preparing a clonal isolate from an LIVP virus sample;
   (ii) assaying the clonal isolate for toxicity;
   (iii) assaying the clonal isolate for anti-tumorigenicity; and
   (iv) selecting the clonal isolate that exhibits greater anti-tumorigenicity and/or reduced toxicity compared to GLV-1h68; and
   the clonal LIVP strain is selected from among:
   a) the clonal LIVP strain designated LIVP 1.1.1, wherein the clonal strain comprises the sequence of nucleotides 2,256-181,114 of SEQ ID NO:1;
   b) the clonal LIVP strain designated LIVP 2.1.1, wherein the clonal strain comprises the sequence of nucleotides 11,243-182,721 of SEQ ID NO:2;
   c) the clonal LIVP strain designated LIVP 4.1.1, wherein the clonal strain comprises the sequence of nucleotides 6,264-181,390 of SEQ ID NO:4;
   d) the clonal LIVP strain designated LIVP 5.1.1, wherein the clonal strain comprises the sequence of nucleotides 7,044-181,820 of SEQ ID NO:5;
   e) the clonal LIVP strain designated LIVP 6.1.1, wherein the clonal strain comprises the sequence of nucleotides 6,674-181,409 of SEQ ID NO:6;
   f) the clonal LIVP strain designated LIVP 7.1.1, wherein the clonal strain comprises the sequence of nucleotides 6,716-181,367 of SEQ ID NO:7;
   g) the clonal LIVP strain designated LIVP 8.1.1, wherein the clonal strain comprises the sequence of nucleotides 6,899-181,870 of SEQ ID NO:8;
   h) a clonal LIVP strain that comprises a sequence of nucleotides that has at least 99% sequence identity to the sequence of nucleotides 2,256-181,114 of SEQ ID NO:1;
   i) a clonal LIVP strain that comprises a sequence of nucleotides that has at least 99% sequence identity to the sequence of nucleotides 11,243-182,721 of SEQ ID NO:2;
   j) a clonal LIVP strain that comprises a sequence of nucleotides that has at least 99% sequence identity to the sequence of nucleotides 6,264-181,390 of SEQ ID NO:4;
   k) a clonal LIVP strain that comprises a sequence of nucleotides that has at least 99% sequence identity to the sequence of nucleotides 7,044-181,820 of SEQ ID NO:5;
   l) a clonal LIVP strain that comprises a sequence of nucleotides that has at least 99% sequence identity to the sequence of nucleotides 6,674-181,409 of SEQ ID NO:6;
   m) a clonal LIVP strain that comprises a sequence of nucleotides that has at least 99% sequence identity to the sequence of nucleotides 6,716-181,367 of SEQ ID NO:7; and
   n) a clonal LIVP strain that comprises a sequence of nucleotides that has at least 99% sequence identity to the sequence of nucleotides 6,899-181,870 of SEQ ID NO:8.

9. An isolated clonal strain produced by:
   propagating the cell or cell culture of claim 8;
   testing clones for greater anti-tumorigenicity or reduced toxicity compared to GLV-1h68;
   selecting a clone from the propagated cell or culture that has greater anti-tumorigenicity or reduced toxicity or both compared to GLV-1h68, wherein GLV-1h68 has the sequence of nucleotides set forth in SEQ ID NO: 9; and
   isolating the selected clone.

10. A recombinant LIVP virus strain that is a derivative of a clonal LIVP strain, comprising deletion of nucleic acid or replacement of nucleic acid with heterologous nucleic acid or insertion of heterologous nucleic acid in the genome of the clonal LIVP strain, whereby the recombinant strain retains the ability to replicate, but is modified in its genomic sequence compared to the genome of the clonal LIVP strain, wherein:
   the recombinant LIVP virus strain has greater anti-tumorigenicity or reduced toxicity or both compared to GLV-1h68, wherein GLV-1h68 has the sequence of nucleotides set forth in SEQ ID NO: 9;
   the genome of the clonal LIVP strain does not contain non-viral heterologous nucleic acid containing an open reading frame encoding a non-viral heterologous protein;
   the clonal LIVP strain has greater anti-tumorigenicity or reduced toxicity or both compared to GLV-1h68, wherein GLV-1h68 has the sequence of nucleotides set forth in SEQ ID NO: 9;

the genome of the clonal LIVP strain comprises a sequence of nucleotides that has at least 95% sequence identity with the sequence of nucleotides set forth in SEQ ID NO:10 but does not comprise the sequence of nucleotides set forth in SEQ ID NO:10; and the isolated clonal strain is produced by or obtainable by a method comprising:
(i) preparing a clonal isolate from an LIVP virus sample;
(ii) assaying the clonal isolate for toxicity;
(iii) assaying the clonal isolate for anti-tumorigenicity; and
(iv) selecting the clonal isolate that exhibits greater anti-tumorigenicity or reduced toxicity or both compared to GLV-1h68; and the clonal LIVP strain is selected from among:
a) the clonal LIVP strain designated LIVP 1.1.1, wherein the clonal strain comprises the sequence of nucleotides 2,256-181,114 of SEQ ID NO:1;
b) the clonal LIVP strain designated LIVP 2.1.1, wherein the clonal strain comprises the sequence of nucleotides 11,243-182,721 of SEQ ID NO:2;
c) the clonal LIVP strain designated LIVP 4.1.1, wherein the clonal strain comprises the sequence of nucleotides 6,264-181,390 of SEQ ID NO:4;
d) the clonal LIVP strain designated LIVP 5.1.1, wherein the clonal strain comprises the sequence of nucleotides 7,044-181,820 of SEQ ID NO:5;
e) the clonal LIVP strain designated LIVP 6.1.1, wherein the clonal strain comprises the sequence of nucleotides 6,674-181,409 of SEQ ID NO:6;
f) the clonal LIVP strain designated LIVP 7.1.1, wherein the clonal strain comprises the sequence of nucleotides 6,716-181,367 of SEQ ID NO:7;
g) the clonal LIVP strain designated LIVP 8.1.1, wherein the clonal strain comprises the sequence of nucleotides 6,899-181,870 of SEQ ID NO:8;
h) a clonal LIVP strain that comprises a sequence of nucleotides that has at least 99% sequence identity to the sequence of nucleotides 2,256-181,114 of SEQ ID NO:1;
i) a clonal LIVP strain that comprises a sequence of nucleotides that has at least 99% sequence identity to the sequence of nucleotides 11,243-182,721 of SEQ ID NO:2;
j) a clonal LIVP strain that comprises a sequence of nucleotides that has at least 99% sequence identity to the sequence of nucleotides 6,264-181,390 of SEQ ID NO:4;
k) a clonal LIVP strain that comprises a sequence of nucleotides that has at least 99% sequence identity to the sequence of nucleotides 7,044-181,820 of SEQ ID NO:5;
l) a clonal LIVP strain that comprises a sequence of nucleotides that has at least 99% sequence identity to the sequence of nucleotides 6,674-181,409 of SEQ ID NO:6;
m) a clonal LIVP strain that comprises a sequence of nucleotides that has at least 99% sequence identity to the sequence of nucleotides 6,716-181,367 of SEQ ID NO:7; and
n) a clonal LIVP strain that comprises a sequence of nucleotides that has at least 99% sequence identity to the sequence of nucleotides 6,899-181,870 of SEQ ID NO:8.

11. The recombinant LIVP virus strain of claim 10, wherein the deletion, insertion or replacement is in a non-essential gene or region in the genome of the clonal LIVP virus strain.

12. The recombinant LIVP virus strain of claim 10, wherein the deletion, insertion or replacement is at the hemagglutinin (HA), thymidine kinase (TK), F14.5L, vaccinia growth factor (VGF), A35R, N1L, E2L/E3L, K1L/K2L, superoxide dismutase locus, 7.5K, C7-K1L, B13R+B14R, A26L or I4L gene loci in the genome of the clonal LIVP virus strain.

13. The recombinant LIVP virus strain of claim 12, wherein the heterologous nucleic acid encodes a gene product that is a therapeutic or diagnostic agent.

14. The recombinant LIVP virus strain of claim 12, wherein the heterologous nucleic acid encodes a gene product that is selected from among an anticancer agent, an antimetastatic agent, an antiangiogenic agent, an immunomodulatory molecule, an antigen, a cell matrix degradative gene product, gene products for tissue regeneration and reprogramming human somatic cells to pluripotency, enzymes that modify a substrate to produce a detectable product or signal or are detectable by antibodies, proteins that can bind a contrasting agent, gene products for optical imaging or detection, gene products for PET imaging and gene products for MRI imaging.

15. The recombinant LIVP virus strain of claim 12, wherein the nucleic acid encodes a gene product that is a therapeutic agent selected from among a hormone, a growth factor, a cytokine, a chemokine, a costimulatory molecule, a ribozyme, a transporter protein, a single chain antibody, an antisense RNA, a prodrug converting enzyme, an siRNA, a microRNA, a toxin, an antitumor oligopeptide, a mitosis inhibitor protein, an antimitotic oligopeptide, an anti-cancer polypeptide antibiotic, an angiogenesis inhibitor, a tumor suppressor, a cytotoxic protein, a cytostatic protein and a tissue factor.

16. The recombinant LIVP virus strain of claim 12, wherein the nucleic acid encodes a gene product that is a diagnostic agent that is a detectable protein or a protein that induces a detectable signal.

17. The recombinant LIVP virus strain of claim 12, wherein the nucleic acid encodes a gene product that is a diagnostic agent selected from among a luciferase, a fluorescent protein, a bioluminescent protein, and a receptor or transporter protein that binds to and/or transports a contrast agent, chromophore, compound or ligand that can be detected.

18. The recombinant LIVP virus strain of claim 12, wherein the nucleic acid encodes a gene product that is selected from among a granulocyte macrophage colony stimulating factor (GM-CSF), monocyte chemotactic protein-1 (MCP-1), interleukin-6 (IL-6), interleukin-24 (IL-24), interferon gamma-induced protein 10 (IP-10), lymphotoxin inducible expression competes with HSV glycoprotein D for HVEM a receptor expressed on T-lymphocytes (LIGHT), p60 superantigen, OspF, OspG, signal transducer and activator of transcription protein (STAT1alpha), STAT1beta, plasminogen k5 domain (hK5), pigment epithelium-differentiation factor (PEDF), single chain anti-VEGF antibody, single chain anti-DLL4 antibody, single chain anti-fibroblast activation protein (FAP), NM23, cadherin 1 (ECAD or cdh1), relaxin 1 (RLN1), matrix metallopeptidase 9 (MMP9), erythropoietin (EPO), microRNA126 (miR-126), microRNA 181, microRNA 335, manganese superoxide dismutase (MnSOD), E3 ubiquitin protein ligase 1 (HACE1), natriuretic peptide precursor A (nppa1), carboxypeptidase G2 (CPG2), alcohol dehydrogenase (ADH), CDC16, bone morphogenetic protein 4 (BMP4), green click beetle luciferase, a lux operon, an infrared fluorescent protein, a flavin reductase protein, mNeptune far-red fluorescent protein, green fluorescent protein (GFP), red fluorescent protein (RFP), coelenterazine-binding protein (CBP), human epinephrine receptor (hNET), a sodium iodide symporter (NIS) protein, a cytochrome p450 family enzyme, allostatin A receptor (AlstR), Pep1 Receptor (PEPR-1), LAT-4, sterol 14 alpha-demethylase (Cyp51), transferring receptor (TR), ferritin, divalent metal transporter (DMT), Magnetotactic A (MagA), cisplatin influx transporter (CTR1), newt AG (nAG), Oct4, NANOG, Ngn3, Pdx1 and Mafa.

19. The recombinant LIVP virus strain of claim 12, wherein the heterologous nucleic acid encoding the heterologous gene product is operably linked to a promoter.

20. The recombinant LIVP virus strain of claim 19, wherein the promoter is a mammalian promoter or a viral promoter.

21. The recombinant LIVP virus strain of claim 19, wherein the promoter is selected from among $P_{7.5k}$, $P_{11k}$, $P_{SE}$, $P_{SEL}$, $P_{SL}$, H5R, TK, P28, Cl1R, G8R, F17R, I3L, I8R, A1L, A2L, A3L, H1L, H3L, HSL, H6R, H8R, D1R, D4R, DSR, D9R, D11L, D12L, D13L, M1L, N2L, P4b and K1 promoters.

22. The recombinant LIVP strain of claim 10, wherein the genome of the clonal LIVP strain consists of the sequence of nucleotides selected from among:
   a) nucleotides 1 to 183,369 of SEQ ID NO:1, nucleotides 1-193,964 of SEQ ID NO:2, nucleotides 1-187,653 of SEQ ID NO:4, nucleotides 1-188,863 of SEQ ID NO:5, nucleotides 1-188,082 of SEQ ID NO:6, nucleotides 1-188,082 of SEQ ID NO:7, or nucleotides 1-188,768 of SEQ ID NO:8; and
   b) a sequence of nucleotides that has at least 99% sequence identity to the sequence of nucleotides 1 to 183,369 of SEQ ID NO:1, nucleotides 1-193,964 of SEQ ID NO:2, nucleotides 1-187,653 of SEQ ID NO:4, nucleotides 1-188,863 of SEQ ID NO:5, nucleotides 1-188,082 of SEQ ID NO:6, nucleotides 1-188,082 of SEQ ID NO:7, or nucleotides 1-188,768 of SEQ ID NO:8.

23. A composition, comprising the recombinant LIVP virus strain of claim 10.

24. A cell culture or isolated cell, comprising the recombinant LIVP strain of claim 10.

25. The composition of claim 23 that is a pharmaceutical composition.

26. A method of treating a proliferative disorder in a subject comprising administering the pharmaceutical composition of claim 1.

27. The method of claim 26, wherein the proliferative disorder is cancer.

28. The method of claim 27, wherein the cancer is breast cancer, prostate cancer, ovarian cancer, lung cancer, colon cancer or pancreatic cancer.

29. The method of claim 26, wherein the subject is a human.

30. The method of claim 26, wherein the subject is a non-human animal that is selected from among a horse, cat, dog, cow, pig, sheep, goat, mouse, rabbit, chicken, rat, and guinea pig.

31. The method of claim 26, further comprising another treatment selected from among surgery, radiation therapy, immunosuppressive therapy and administration of an anticancer agent, wherein the further treatment is effected before, after, simultaneously or intermittently with the virus.

32. The method of claim 31, wherein the further treatment is administration of an anticancer agent selected from among a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anticancer antibody, an anti-cancer antibiotic, an immunotherapeutic agent and a combination of any of the preceding thereof.

33. A method of detecting a tumor or metastasis in a subject, comprising:
   administering to the subject the clonal strain of claim 16; and
   detecting the detectable protein or a protein that induces a detectable signal, whereby detection indicates the presence of the tumor or metastasis in the subject.

34. The method of claim 33, wherein detection is effected by imaging the subject.

35. The method of claim 33, wherein detection is effected by detecting the protein or signal in a tissue or body fluid sample.

36. The method of claim 33, wherein the detectable protein or protein that induces a detectable signal is selected from among a luciferase, a fluorescent protein, a bioluminescent protein, a receptor or transporter protein that binds to and/or transports a contrast agent, chromophore, compound or ligand that can be detected.

37. The method of claim 33, wherein the detectable protein or detectable signal is detected by low-light imaging, fluorescence spectroscopy, x-ray imaging, magnetic resonance imaging (MRI), magnetic resonance spectroscopy (MRS), positron emission tomography (PET) or single-photon emission computed tomography (SPECT).

38. An LIVP preparation produced by:
   propagating the cell or cell culture of claim 8; and
   testing clones for greater anti-tumorigenicity or reduced toxicity compared to GLV-1h68; and
   selecting a clone that has one or both of greater anti-tumorigenicity and reduced toxicity compared to GLV-1h68, wherein GLV-1h68 has the sequence of nucleotides set forth in SEQ ID NO:9.

39. An isolated clonal strain produced by:
   propagating the cell or cell culture of claim 24;
   testing clones for greater anti-tumorigenicity or reduced toxicity compared to GLV-1h68; and
   selecting a clone that has one or both of greater anti-tumorigenicity and reduced toxicity compared to GLV-1h68, wherein GLV-1h68 has the sequence of nucleotides set forth in SEQ ID NO:9.

40. An LIVP preparation produced by:
   propagating the cell or cell culture of claim 24;
   testing clones for greater anti-tumorigenicity or reduced toxicity compared to GLV-1h68; and
   selecting a clone that has one or both of greater anti-tumorigenicity and reduced toxicity compared to GLV-1h68, wherein GLV-1h68 has the sequence of nucleotides set forth in SEQ ID NO:9.

41. The recombinant LIVP virus of claim 10, wherein the heterologous nucleic acid encodes a heterologous gene product.

42. A method of producing a recombinant LIVP virus strain of claim 10, comprising deleting nucleic acid or replacing nucleic acid with heterologous nucleic acid or inserting heterologous nucleic acid in the genome of the clonal LIVP strain.

43. The method of claim 42, wherein the deletion, insertion or replacement is in a non-essential gene or region in the genome of the clonal LIVP strain.

44. The method of claim 42, wherein the heterologous nucleic acid encodes a heterologous gene product.

45. The pharmaceutical composition of claim 6, wherein the clonal strain has reduced toxicity compared to the virus designated GLV-1h68 having a sequence of nucleotides set forth in SEQ ID NO:9.

46. The pharmaceutical composition of claim 2, wherein the virus comprises a heterologous nucleic acid inserted into a nonessential region of the genome or in place of all or part thereof.

47. The recombinant LIVP virus strain of claim 10, wherein the recombinant LIVP virus strain comprises heterologous nucleic acid encoding a gene product selected from among vaccinia virus complement control protein (VCP), DAF/CD55, CD59, MCP/CD46, interleukin-2 (IL-2), interleukin-15 (IL-15) and human sodium iodide symporter (hNIS).

48. The recombinant LIVP virus strain of claim 10, wherein the recombinant LIVP virus strain comprises heterologous nucleic acid encoding a gene product selected from among IL-24, WT1, p53, *Pseudomonas* A endotoxin, diphtheria toxin, Arf, Bax, HSV TK, *E. coli* purine nucleoside phosphorylase, angiostatin, endostatin, p16, Rb, BRCA1, cystic fibrosis transmembrane regulator (CFTR), Factor VIII, low density lipoprotein receptor, beta-galactosidase, alpha-galactosidase, beta-glucocerebrosidase, insulin, parathyroid hormone, alpha-1-antitrypsin, rsCD40L, Fas-ligand, TRAIL, TNF, antibodies, microcin E492, diphtheria toxin, *Pseudomonas* exotoxin, *Escherichia coli* Shiga toxin, *Escherichia coli* Verotoxin 1, hyperforin, interleukin-1, interleukin-2, interleukin-6, interleukin-12, tumor necrosis factor alpha (TNF-α), interferon gamma (IFN-γ), granulocyte macrophage colony stimulating factor (GM-CSF), erythropoietin, IL-8, GROα, GROβ, GROγ, ENA-78, LDGF-PBP, GCP-2, PF4, Mig, IP-10, SDF-1α/β, BUNZO/STRC33, I-TAC, BLC/BCA-1; MIP-1α, MIP-1β, MDC, TECK, TARC, RANTES, HCC-1, HCC-4, DC-CK1, MIP-3α, MIP-3β, MCP-1, MCP-2, MCP-3, MCP-4, Eotaxin, Eotaxin-2/MPIF-2, 1-309, MIP-5/HCC-2, MPIF-1, 6Ckine, CTACK, MEC, lymphotactin, fractalkine, erythropoietin, an anti-VEGF single chain antibody, a plasminogen K5 domain, a human tissue factor-αvβ3-integrin RGD fusion protein, interleukin-24, and SIL-6-SIL-6 receptor fusion protein.

49. The pharmaceutical composition of claim 1, wherein:
the clonal LIVP strain comprises the sequence of nucleotides 2,256-181,114 of SEQ ID NO:1 or a sequence of nucleotides that has at least 99% sequence identity to nucleotides 2,256-181,114 of SEQ ID NO:1.

50. The recombinant LIVP virus strain of claim 10 that is a derivative of the clonal LIVP strain designated LIVP 1.1.1, comprising deletion of nucleic acid or replacement of nucleic acid with heterologous nucleic acid or insertion of heterologous nucleic acid in the genome of LIVP 1.1.1, whereby the recombinant strain retains the ability to replicate, but is modified in its genomic sequence compared to the genome of LIVP 1.1.1, wherein:
the LIVP 1.1.1 comprises the sequence of nucleotides 2,256-181,114 of SEQ ID NO:1 or a sequence of nucleotides that has at least 99% sequence identity to a sequence of nucleotides 2,256-181,114 of SEQ ID NO:1; and
the recombinant LIVP virus strain has greater anti-tumorigenicity or reduced toxicity or both compared to GLV-1h68, wherein GLV-1h68 has the sequence of nucleotides set forth in SEQ ID NO: 9.

51. An isolated clonal strain produced by:
propagating the cell or cell culture of claim 8; and
isolating an LIVP clone from the propagated cell or culture.

52. A cell culture or isolated cell, comprising the recombinant LIVP strain of claim 48.

53. The method of claim 42, wherein the deletion, insertion or replacement is in a non-essential gene or region in the genome of LIVP 1.1.1.

54. The pharmaceutical composition of claim 6, wherein the clonal LIVP strain has greater anti-tumorigenicity.

55. The pharmaceutical composition of claim 6, wherein the clonal LIVP strain has greater anti-tumorigenicity and reduced toxicity.

56. A pharmaceutical composition, comprising an isolated clonal LIVP strain derived from an LIVP strain that comprises the sequence of nucleotides set forth in any of SEQ ID NOS: 1, 2, 4, 5, 6, 7 and 8.

57. A pharmaceutical composition, comprising an isolated clonal LIVP strain, wherein:
the genome of the clonal strain comprises the sequence of nucleotides selected from among:
a) nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7, or nucleotides 6,899-181,870 of SEQ ID NO:8; and
b) a sequence of nucleotides that has at least 99% sequence identity to the sequence of nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7, or nucleotides 6,899-181,870 of SEQ ID NO:8.

58. The pharmaceutical composition of claim 57, wherein the genome of the clonal strain consists of the sequence of nucleotides selected from among:
a) nucleotides 1 to 183,369 of SEQ ID NO:1, nucleotides 1-193,964 of SEQ ID NO:2, nucleotides 1-187,653 of SEQ ID NO:4, nucleotides 1-188,863 of SEQ ID NO:5, nucleotides 1-188,082 of SEQ ID NO:6, nucleotides 1-188,082 of SEQ ID NO:7, or nucleotides 1-188,768 of SEQ ID NO:8; and
b) a sequence of nucleotides that has at least 99% sequence identity to the sequence of nucleotides 1 to 183,369 of SEQ ID NO:1, nucleotides 1-193,964 of SEQ ID NO:2, nucleotides 1-187,653 of SEQ ID NO:4, nucleotides 1-188,863 of SEQ ID NO:5, nucleotides 1-188,082 of SEQ ID NO:6, nucleotides 1-188,082 of SEQ ID NO:7, or nucleotides 1-188,768 of SEQ ID NO:8.

59. An isolated clonal LIVP strain, wherein:
the genome of the clonal strain comprises the sequence of nucleotides selected from among:
a) nucleotides 2,256-181,114 of SEQ ID NO:1, nucleotides 11,243-182,721 of SEQ ID NO:2, nucleotides 6,264-181,390 of SEQ ID NO:4, nucleotides 7,044-

181,820 of SEQ ID NO:5, nucleotides 6,674-181,409 of SEQ ID NO:6, nucleotides 6,716-181,367 of SEQ ID NO:7, or nucleotides 6,899-181,870 of SEQ ID NO:8; and b) a sequence of nucleotides that has at least 99% sequence identity to the sequence of nucleotides 2,256-181,114 of SEQ ID NO:1, nucleotides 11,243-182,721 of SEQ ID NO:2, nucleotides 6,264-181,390 of SEQ ID NO:4, nucleotides 7,044-181,820 of SEQ ID NO:5, nucleotides 6,674-181,409 of SEQ ID NO:6, nucleotides 6,716-181,367 of SEQ ID NO:7, or nucleotides 6,899-181,870 of SEQ ID NO:8;

the clonal strain has greater anti-tumorigenicity and/or reduced toxicity compared to GLV-1h68; and GLV-1h68 has the sequence of nucleotides set forth in SEQ ID NO:9.

60. The pharmaceutical composition of claim 1, wherein:
the genome sequence of the clonal strain differs from a sequence of nucleotides selected from among SEQ ID NOs: 1, 2 and 4-8 only by modification(s) of one or more open reading frames encoding a protein; and
the modification(s) do not change the amino acid sequence of the encoded protein.

61. The pharmaceutical composition of claim 6, wherein:
the genome sequence of the clonal strain differs from a sequence of nucleotides selected from among SEQ ID NOs: 1, 2 and 4-8 only by modification(s) of one or more open reading frames encoding a protein; and
the modification(s) do not change the amino acid sequence of the encoded protein.

62. The cell culture or isolated cell of claim 8, wherein:
the genome sequence of the clonal strain differs from a sequence of nucleotides selected from among SEQ ID NOs: 1, 2 and 4-8 only by modification(s) of one or more open reading frames encoding a protein; and
the modification(s) do not change the amino acid sequence of the encoded protein.

63. The recombinant LIVP strain of claim 10, wherein:
the genome sequence of the clonal strain differs from a sequence of nucleotides selected from among SEQ ID NOs: 1, 2 and 4-8 only by modification(s) of one or more open reading frames encoding a protein; and
the modification(s) do not change the amino acid sequence of the encoded protein.

64. The pharmaceutical composition of claim 57, wherein:
the genome sequence of the clonal strain differs from a sequence of nucleotides selected from among SEQ ID NOs: 1, 2 and 4-8 only by modification(s) of one or more open reading frames encoding a protein; and
the modification(s) do not change the amino acid sequence of the encoded protein.

65. The isolated clonal LIVP strain of claim 59, wherein:
the genome sequence of the clonal strain differs from a sequence of nucleotides selected from among SEQ ID NOs: 1, 2 and 4-8 only by modification(s) of one or more open reading frames encoding a protein; and
the modification(s) do not change the amino acid sequence of the encoded protein.

\* \* \* \* \*

UNITED STATES PATENT AND TRADEMARK OFFICE
CERTIFICATE OF CORRECTION

| | | |
|---|---|---|
| PATENT NO. | : 11,149,254 B2 | Page 1 of 1 |
| APPLICATION NO. | : 13/506369 | |
| DATED | : October 19, 2021 | |
| INVENTOR(S) | : Szalay et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 48 days.

Signed and Sealed this
Twenty-fifth Day of October, 2022

Katherine Kelly Vidal
*Director of the United States Patent and Trademark Office*